United States Patent 9,149,506 (MODIFIED POLYNUCLEOTIDES ENCODING SEPTIN-4) - sequence listing, part 19

SEQ ID NO: 32578 - DNA, 1434 bp, Artificial Sequence
  Description of Artificial Sequence: Synthetic coding sequence
atggatcgatcgctgggatggcagggtaattcggttcccgaagaccggaccgaggccggaattaagcgtttcctggaggatacaacagacgatggcgagctcagtaaatttgtgaaggacttttctggcaacgcctcatgccatccccctgaagccaagacgtgggcctcccggccacaagtgcccgagcccaggccacaggcccccgatctatacgacgacgatttggaatttcgtcctccttccaggccacagtcatctgataaccagcaatatttctgtgctcccgctccactgtcgccttcagccagacctaggtcaccttggggaaagctggatccatatgatagctctgaggacgacaaagaatacgtcggattcgctacactacctaaccaggtccacaggaagtcggtcaaaaagggcttcgactttaccctcatggttgccggtgagagcggcctagggaaatctactctggtgaactctcttttccttactgacctatatcgcgaccgcaaactgcttggggccgaggagcggatcatgcagacggtggaaattaccaagcacgccgtggacattgaagaaaagggcgtccgactacggctgacgattgtagatacgccaggctttggagatgctgtgaacaatacagaatgctggaagccggtggctgagtacatcgatcagcaatttgagcagtactttcgggatgagagcggactgaataggaagaacatccaggataatcgcgttcattgctgtttgtatttcataagtccctttgggcacggattgcggccgctcgatgtggaatttatgaaagccctgcaccagcgggttaacatcgttccaattcttgcaaaagccgacactctgacaccgccggaagtcgaccacaagaagcggaagatcagggaagaaatcgaacacttcggcataaaaatttatcaatttcccgactgcgactctgacgaggatgaggactttaaactccaggatcaagccctgaaagagtcaatccccttcgcagtgatcggtagtaacacagttgtggaggccagggggaggcgcgttagaggtagactttacccctggggcatcgttgaagtggaaaatccgggacattgtgacttcgtcaaactgagaacaatgttggtacgaacacatatgcaggatctgaaagacgttacacgagagacacactacgaaaactaccgggcacagtgcatacagtctatgaccagactggttgtaaaggagagaaatcgaaataaactgacccgagagagtggaacggactttcctattcccgccgtgccccctgggactgacccagagacggagaaactcatcagggagaaagatgaggaactgagacgtatgcaggagatgttgcacaagattcagaaacagatgaaggaaaattat

SEQ ID NO: 32579 - DNA, 1434 bp, Artificial Sequence
  Description of Artificial Sequence: Synthetic coding sequence
atggatcgctcccttgggtggcaggggaattccgttccagaggaccggaccgaggctgggatcaaacggttcctggaagacaccaccgacgatggggaacttagtaaatttgtgaaggatttttcaggcaacgctagttgccacccccccgaggccaaaacatgggcttctcgaccccaagtgcctgagccgaggccccaggctcccgatctgtatgacgatgacctggaatttcggccccctagtcggcctcagtcatccgacaaccagcagtatttttgtgcacccgcccctcttagtccttccgcccggcctaggtccccttggggtaagcttgatccctatgactcttctgaggacgacaaggagtacgtggggtttgccacattgccaaaccaggttcatcggaagtctgtgaaaaagggcttcgatttcactctgatggtcgcgggcgaaagtggtctgggaaagtctacactggtcaactccttgtttctcacagatctctatcgagatagaaaactgctcggcgctgaggagcggatcatgcagacagtggaaattacaaagcatgccgttgatatcgaagagaagggggtccggctgcggctgacaattgtggacactccggggttcggggacgcggtgaacaacacagaatgttggaagcccgttgctgagtatatagatcagcaattcgagcagtactttcgggatgagtccgggcttaaccgtaagaatatacaggacaaccgtgttcactgttgtctgtattttatctcgccctttggacacggtctgaggccactcgacgtggaatttatgaaggcactgcaccagagggtaaacatcgttcccatcctggccaaagcagacaccctcaccccccctgaggtggaccacaagaagcgaaagattcgagaagagattgaacactttggcataaagatttaccagttccctgactgtgactctgacgaggatgaagactttaagcttcaggaccaggccttgaaagagtcaattccttttgcggtcatcggtagcaatacagtggttgaagcaaggggacggagagtccggggcagattgtatccctggggaattgtcgaagtagagaatccgggtcattgtgattttgttaagttgcgcacaatgcttgtacggacgcatatgcaggacctcaaagacgtaactagggagacacactacgagaattatcgggcacagtgcatacagtcaatgacgagattggttgtgaaggagagaaacagaaacaaactaaccagggaatctggtactgactttcccatcccagctgtacccccaggaaccgaccccgaaacagagaagctaataagggaaaaggacgaggagttgaggagaatgcaggagatgctacacaagattcagaagcagatgaaagagaactac

SEQ ID NO: 32580 - DNA, 1434 bp, Artificial Sequence
  Description of Artificial Sequence: Synthetic coding sequence
atggacagatcgctgggctggcagggcaactccgtcccggaagataggactgaggctggaattaagcggtttctggaagatacaactgatgatggtgagctgtctaaatttgtcaaggatttctcaggcaacgcctcctgtcatccgccagaagccaaaacttgggctagtaggccacaggtacctgaaccgagacctcaggcgcccgatctatacgatgatgacctggagtttaggcctccaagtcgcccccagtcatcagacaaccagcagtatttttgcgcaccagccccccttagccccagtgccaggcctcggagcccctggggtaagctggatccttacgatagcagtgaggacgacaaggaatacgttggatttgctacactgccaaaccaagtccaccggaagagcgtcaaaaaaggttttgattttaccctgatggtcgcaggtgaaagcggacttgggaagagcacactagtcaactctctgttcctgaccgacctctatcgggaccgaaaattgttaggagctgaggaaagaataatgcaaacagtggagataaccaagcatgcagtcgatatcgaggagaaaggagtgaggcttcgcctgaccatcgtggataccccagggttcggcgacgcagtgaacaataccgaatgctggaaaccagttgccgaatacattgaccagcagtttgaacagtattttcgggatgaaagcgggctgaatagaaaaaacattcaagataacagagttcactgttgtctgtatttcatttcacccttcggacacggtcttcgcccactggacgtggagtttatgaaagcactccatcagcgagtgaacattgtcccaatcctcgctaaggctgacacacttacacctccagaggtggatcacaagaagcgcaaaataagagaagaaatcgagcattttggcatcaagatctaccagttccccgattgcgatagtgatgaggatgaggacttcaagctccaggatcaagccctgaaagagagcatccctttcgctgtgattgggtccaacactgtggtggaggccaggggaagacgtgtccgcggcagactttacccctggggaatcgtggaagttgagaatccagggcattgtgattttgtgaagttacgaacaatgctggtgaggactcacatgcaagatttaaaggacgtgaccagggagacacattatgaaaactacagggcccaatgcatccagtcaatgacacgattggtggtaaaagagcggaacaggaacaagctcaccagggaatctgggaccgatttccctatccctgccgtccctccaggcacagatccagagaccgaaaaactgatcagagaaaaggatgaagagctccgaagaatgcaagaaatgcttcacaaaatccagaagcaaatgaaggaaaactac

SEQ ID NO: 32581 - DNA, 1434 bp, Artificial Sequence
  Description of Artificial Sequence: Synthetic coding sequence
atggatcgttcacttggatggcaaggaaactccgtgcctgaagatcgcacggaggcaggtatcaagcgcttcctcgaagatactacggacgacggcgagctgtcaaagttcgtaaaagatttctcgggaaacgcctcgtgtcatccacctgaggccaagacgtgggcctcccggccgcaagtccccgaaccccgccctcaggcaccagacctctacgatgatgacctggagtttcggcctccatcgaggccccaaagctccgacaaccagcaatacttttgtgcacccgctccactttcaccgagcgcaagaccacgatcgccttggggcaagttggatccttacgattcgagcgaagatgataaagaatacgtgggctttgccaccctgccaaaccaagtgcacagaaagagcgtgaaaaaaggttttgattttactctgatggtcgcaggagaatcggggctgggaaaatcaactttggtgaattcgttgtttttgaccgatctttatagagatcgcaaactgctgggggccgaggaaagaattatgcaaaccgtcgaaattacgaaacatgcagtcgacattgaagaaaaaggtgtcagactccgtcttacgatcgtcgatactcctggatttggagacgcagtgaacaatacggagtgttggaaaccagtggcggagtacatagatcagcagttcgagcaatactttcgggacgagtccggtctgaacagaaagaatatccaggataatagggtgcactgctgtctttacttcattagcccgttcgggcacggactccgcccgctcgacgtggaattcatgaaggcactgcatcagcgtgtcaacatcgtgcctatcctcgcgaaagcagatactcttactccaccagaagttgatcacaagaagcggaaaatccgggaagaaatagaacattttggaataaagatctatcaattcccagactgcgattcggatgaggatgaagatttcaaactgcaggaccaagcactgaaagaatcgattccattcgcagtgattggttcgaatactgtcgtggaggcgagagggcgtagagtgagaggcagactttacccttggggtatcgtggaagttgagaatccgggccattgcgactttgtgaaacttcggaccatgctggtgaggactcacatgcaagatctgaaggacgtgactcgcgagactcattacgagaactaccgcgcacaatgcattcagagcatgaccagactggtggttaaggaaagaaacaggaataaactcacgcgggagagcgggaccgactttcctattcccgcagttcctcctggaactgacccggagacggaaaagctgatacgggaaaaggatgaagagctgcgacgcatgcaagagatgcttcataagattcaaaagcaaatgaaggagaactac

SEQ ID NO: 32582 - DNA, 1434 bp, Artificial Sequence
  Description of Artificial Sequence: Synthetic coding sequence
atggataggtccctgggctggcagggcaattcggttccagaggacaggaccgaggctggaatcaaacgttttctggaggacaccaccgacgacggtgagctgagcaaattcgtcaaggacttctcggggaatgcgagctgccatccacctgaggcaaagacgtgggcatccagaccccaagtgcctgagcccagacctcaggcaccagatctgtacgatgatgatctcgagtttagacctccctcgaggccccaatctagcgataaccaacagtacttttgtgcacctgcccccctttcgccatctgcacgtccacgatcgccttggggaaaacttgatccctacgacagcagcgaagatgataaggaatacgtcggtttcgccactctccctaaccaagtgcatcggaagtcagtcaagaagggtttcgactttactctgatggtcgcaggggagtcaggactgggaaaatcgacccttgtgaactcactgtttttgaccgatctgtatcgcgatcggaagctgctgggtgcagaggagaggatcatgcaaactgtggagataaccaagcacgccgtggatattgaagaaaagggagtgaggctgagactcaccattgtcgacacccctggttttggcgacgcagtcaacaacaccgaatgttggaaacctgtggcagaatacatcgatcaacaattcgaacaatacttccgcgatgaatcgggccttaatagaaagaatatccaagataaccgcgtgcactgttgtctttacttcatctccccttttggacatggtctgcgccccctggacgtggagtttatgaaggcactccaccaaagggtgaatatcgtgcctattctggccaaggccgacacgctcaccccaccagaggtcgatcacaagaaaagaaagatccgcgaggaaattgagcattttggtatcaagatttaccagttccctgactgcgattcggatgaagatgaagatttcaagttgcaggatcaagccctgaaagaatcgatcccatttgcagtcatcggttcgaataccgtcgtggaagcccgcgggcgccgagtgcggggcaggctgtacccctggggaattgtggaggtggaaaaccctggacattgcgactttgtgaaactcaggactatgttggttaggacgcatatgcaggatctgaaggacgtgactcgtgaaacccactacgagaattaccgagcccagtgtattcagtccatgacccgccttgtagtcaaggaacgcaaccgaaacaaacttaccagagagagcgggaccgatttccctatacccgcagtccctcccggcaccgaccctgaaactgaaaagctgattagagagaaggatgaagagctcagacgaatgcaggagatgctgcataagattcaaaagcagatgaaggagaactac

SEQ ID NO: 32583 - DNA, 1434 bp, Artificial Sequence
  Description of Artificial Sequence: Synthetic coding sequence
atggataggtccctcggatggcagggtaatagcgtccctgaggatcggaccgaagccggaattaagcgctttctcgaagataccaccgacgacggggaacttagcaagtttgtgaaggatttctccggaaacgcaagctgtcatcctccagaagcgaaaacgtgggcttcacgaccacaggtcccggaacccagaccccaagcgccagacctttacgacgatgatcttgagtttaggcctcccagccggccccagagctctgataatcagcaatacttctgcgcacctgctcctctttcgcccagcgctagaccacggagcccatggggaaagctggacccgtacgactcctccgaggatgacaaggagtacgtcgggtttgcgactctcccaaaccaggtgcatagaaagagcgtcaagaaaggctttgattttaccctgatggtggcaggagaatccgggctggggaaaagtacgttggtgaactccctgtttctgactgatctctaccgggatagaaaactcctgggtgcagaagaaagaatcatgcaaactgtggaaatcaccaagcacgctgtggatattgaagaaaagggcgtgagactcaggctgactatcgtggatacccctggatttggcgacgcagtgaacaataccgagtgttggaagcctgtggcagaatacattgaccaacagttcgaacagtattttcgtgatgagtccggtctgaaccggaaaaacatacaagataatagggtccactgttgtctgtatttcatctcaccatttgggcatgggctgaggccactggatgtggaattcatgaaggcgctgcatcagagggtcaatatcgtgcctatacttgcaaaggcagacacgcttacccctcctgaggtggaccataagaaaagaaagatcagagaagaaatcgaacatttcggaattaagatatatcaatttccagactgtgattcggacgaggatgaagatttcaaacttcaagatcaggccctcaaagagtccattccattcgcagtgatcgggtcgaacaccgtggtggaagcacgaggtcgacgggtgagaggacggctttacccttggggaatcgtggaggtggaaaacccaggccattgcgattttgtgaaacttcggaccatgcttgtcagaacccatatgcaggacctgaaggacgtgaccagagaaacccactacgagaattaccgtgcccagtgcatacaatccatgactaggctggtggtgaaagaaagaaacagaaataagctgacgcgagagtcgggtactgattttcctattcccgccgtgccacctggtactgatccagagactgaaaagctcattcgcgaaaaggatgaagaactcagacggatgcaggaaatgttgcacaagatccagaagcagatgaaggagaattac

SEQ ID NO: 32584 - DNA, 1434 bp, Artificial Sequence
  Description of Artificial Sequence: Synthetic coding sequence
atggataggtcactcggatggcaggggaattccgtgcctgaagataggactgaagcaggaataaaaagatttctggaagatacaacagacgatggggagctatctaaattcgtaaaagatttcagtgggaacgcgtcgtgtcacccacctgaagctaaaacttgggcatctcggccacaggtacccgagcccagacctcaggctcccgacctttacgatgatgatctcgaattcaggccaccctcgcggcctcagtcttccgataatcagcagtatttttgcgcccccgccccactctcacctagtgccaggcctagatctccatggggaaaactggatccctacgattcctctgaagatgataaagaatacgtggggttcgctacactacccaaccaggtgcaccgaaagtccgtcaaaaaaggatttgactttacacttatggtcgcaggagaatcggggctcggaaaatctactctagtaaacagtttattcctcacagatctttatcgggatcgaaaactgctgggagctgaagaaagaatcatgcagacagtggaaataacaaaacatgccgttgacattgaagaaaagggagtacggctgcgactcactattgttgacactccaggatttggggatgctgtgaataatactgagtgttggaaaccagtcgccgaatatatcgaccagcagttcgaacagtatttccgtgatgaatctggacttaaccgcaaaaatatacaagataatagagtgcactgttgcctatacttcatctcccccttcgggcatgggctaagaccccttgatgtggaattcatgaaagctctacaccagcgggtcaatattgttcccatattggccaaagctgatacacttactccacctgaagtggaccacaaaaaaaggaagatccgggaggaaatagaacattttggaataaaaatttatcagtttccagattgtgactccgatgaagatgaagatttcaaactccaagaccaagctctcaaagaatcaatcccattcgccgttatagggagtaatactgtcgtggaagctcgggggcgccgggtgaggggaagactgtacccctgggggatagtagaagtggaaaaccccgggcattgtgatttcgtcaaacttaggacaatgctggtgcgcacacacatgcaagatttgaaagacgtgacaagggaaactcattatgaaaattatagggctcagtgtatccagtctatgacaagactggttgtgaaagaacgaaataggaacaaactcacacgagaatccggaacagatttcccaattcctgccgtgccccccggaacagatccagaaacagaaaaattgatacgcgaaaaggatgaagaattaagaagaatgcaggaaatgctccataaaattcagaaacagatgaaggaaaattat

SEQ ID NO: 32585 - DNA, 1434 bp, Artificial Sequence
  Description of Artificial Sequence: Synthetic coding sequence
atggaccggagtcttggctggcaggggaatagcgtacctgaagacaggacagaggcaggcataaagagattcctcgaagatactactgacgacggtgaactgtctaaattcgtcaaagatttcagtggaaacgctagctgccacccgccggaggctaaaacatgggccagcaggccacaggtccccgagcctcgaccacaagccccagacttgtacgatgatgaccttgagtttaggcctccttctaggccacagtctagcgataatcaacagtatttctgcgcaccagctcccctgtcccctagcgcgcgcccccggtcaccatggggtaagctggatccttacgatagctctgaggacgacaaggagtacgtgggtttcgctaccctaccaaatcaagtgcaccgcaaatccgtcaaaaaaggctttgattttacactgatggttgctggcgaaagtgggcttgggaagtctaccctggtcaactcactcttcctgacagatctgtatagagatcgcaaacttcttggagcagaggaacgcattatgcagactgtcgaaatcaccaaacacgccgtagacattgaagagaaaggcgttaggcttaggctgaccatcgtggatacaccgggctttggagatgctgtgaacaacactgagtgttggaaacctgtcgcagaatacatagatcagcagttcgagcaatactttagggatgagtctggattgaaccgaaaaaacatccaggacaatagagtacattgctgtttgtactttatcagccctttcggccacggtctcaggcccctggacgtggagttcatgaaggctctccaccaaagagttaatatcgtacctatcttggcaaaggcagatacattaacccccccagaggttgaccacaaaaaaaggaagatcagagaagagattgaacactttggtatcaagatctatcaatttcctgattgcgactctgacgaggacgaagattttaagcttcaggaccaggctctaaaagaatcaattccctttgccgtcatcggcagtaacacagtagttgaggccagaggtcgcagggtcagggggcggctgtatccatggggcatcgtcgaggttgagaaccctggacattgcgatttcgtgaaactaagaacgatgctggttcgcacccatatgcaagatttgaaagatgtcacgcgggagacccattacgaaaactatagggctcagtgcatacaatctatgactagactggtcgtgaaggagagaaacagaaataaactgactcgggagtctggcaccgatttcccgattcctgcagtgccgcccggtactgacccagagacagaaaaacttatccgcgagaaggatgaagaactcaggaggatgcaagagatgctgcacaagattcaaaaacaaatgaaagaaaactac

SEQ ID NO: 32586 - DNA, 1434 bp, Artificial Sequence
  Description of Artificial Sequence: Synthetic coding sequence
atggacagaagtttaggctggcaaggaaatagtgtcccagaagatagaacggaggctggaataaagcgtttcctcgaagatacgactgatgatggagaattgagtaagtttgttaaggatttctctggtaatgcgagctgccatccaccagaagctaagacatgggcttcaagaccacaagtgccggaaccacgcccccaggctccagatctctacgatgacgaccttgagtttcgcccaccatccagaccacaatcttctgataaccagcaatatttctgtgcaccagcaccactttctcctagtgcacgcccgcgatcaccatggggtaagctggatccatacgattcatccgaagatgacaaggagtatgtcggattcgctacgttaccgaatcaagtacaccgaaagagtgttaagaaaggttttgatttcactttgatggtcgccggcgaatcaggacttggtaaaagcacactggtaaatagtctattccttactgatttataccgtgatagaaaacttctcggagcagaagaaagaatcatgcaaactgtggaaataacaaaacatgccgtagatattgaagaaaaaggtgtccgcttgcgattaacaatcgtagataccccaggttttggagatgcagttaacaatacagaatgctggaaaccagtcgccgaatatattgatcaacaatttgagcaatattttcgcgatgaatccggacttaaccgtaagaatattcaagataatagagtacattgctgtttgtatttcatctctcccttcggtcatggattgcgaccacttgatgttgaattcatgaaggcactgcaccaaagggtgaatattgttccgatccttgccaaggctgacacattaacaccgccagaggtcgaccataagaaacgaaaaatacgagaagaaatcgagcatttcggaattaaaatataccaatttccggattgcgatagcgatgaggatgaggattttaagcttcaggaccaggctttaaaggaatcgattccttttgctgtgattggatccaatacggttgtagaagcacgggggcgacgagtgcgcggaagactttatccctggggtatcgtagaagttgaaaatcctggacattgtgatttcgtgaaactccgtacaatgttggtccgaacccatatgcaagatctcaaagatgtaactcgggagactcattatgaaaattatcgagcccaatgtattcagtcaatgaccaggttggtcgttaaggaacgcaatagaaataaactcaccagagagtcgggaacggacttccctatcccggccgttccaccgggtacagatcctgaaacggagaaattaattagagagaaagatgaggaattacgcagaatgcaagagatgcttcacaagattcagaagcaaatgaaagaaaattat

SEQ ID NO: 32587 - DNA, 1434 bp, Artificial Sequence
  Description of Artificial Sequence: Synthetic coding sequence
atggatcgctccctgggatggcaaggtaacagcgtgccggaggacagaaccgaggccggaatcaagcggttcctggaagacactaccgacgacggagaactgtccaaattcgttaaggacttctcgggaaacgccagctgtcacccgccggaagccaagacctgggcttcaaggccgcaagtgccggaaccgaggcctcaggccccggatctgtacgacgacgaccttgagtttagaccaccgtcacggccgcaatcatccgataaccagcagtacttctgcgctccggcgcctctgtcaccctcagcgcgcccgcggtcgccatggggaaagctcgacccgtacgattcgtctgaggacgataaagagtacgtgggcttcgcaaccctgccaaatcaagtccatcgcaagagcgtgaagaagggattcgattttactctgatggtggcaggagagtctggactcggaaagtccacgctcgtcaattcattgttccttactgacttgtaccgggaccggaagttgctcggtgccgaggaacgcatcatgcaaaccgtcgagattaccaaacacgcagtggacatcgaagagaagggagttagactgcggctgactattgtggacacccccggtttcggcgatgctgtcaacaatactgaatgctggaagccggtggcggagtacatcgaccaacaattcgagcagtattttagagacgaatcgggccttaatcgtaagaacatccaggataaccgggtgcactgttgcctgtacttcatcagcccgttcggccatggtcttaggccgctggacgtggaatttatgaaggccctgcaccagagagtcaatatcgtgccgatactggcgaaagctgacaccctgactccgccggaggtggaccataagaaaagaaagattcgcgaagagatcgaacacttcggaatcaaaatctaccaatttccagactgtgactctgatgaggacgaggactttaagttgcaagatcaggctctcaaggaatccatccccttcgccgtcatcggatcgaacacggtcgtcgaagcgagaggccgccgcgtgcgaggaagactgtacccgtggggaattgtggaagtggagaatccaggccactgcgatttcgtgaaacttaggactatgctcgtccgcactcacatgcaggacctcaaggacgtcaccagggaaactcactacgaaaactaccgcgcccaatgcatccaatcaatgacccggctggtcgtgaaggagagaaacagaaacaagctgactagggaatccggcaccgacttcccaatccctgcggtgccgcctggaaccgacccggagacggaaaagctgatcagagaaaaggacgaggaactccgaaggatgcaggaaatgctccacaagattcagaagcagatgaaggagaactac

SEQ ID NO: 32588 - DNA, 1434 bp, Artificial Sequence
  Description of Artificial Sequence: Synthetic coding sequence
atggatcgcagtttagggtggcagggaaactccgtgcccgaagatcgcactgaggcagggatcaaacggttcctggaagatacaactgacgatggagaactatccaaattcgtgaaagatttcagtgggaatgcatcatgccacccccccgaggctaaaacttgggcctcacggcctcaggtgcctgaaccacggccacaggcccccgatctttatgatgatgatcttgaatttagacctccttcaagacctcagtcctccgataaccaacagtacttctgtgctcccgcccccctgtctccatctgcgaggcctcgaagtccctgggggaaactcgatccatatgattcttccgaagatgataaagagtatgtgggattcgccactttgcctaatcaggtgcacaggaaaagtgtaaaaaaagggttcgactttacactgatggtggccggggagtctggactgggaaaaagtacactcgtgaactctttattcctgacagacctatacagggacaggaaactacttggagccgaagaacggattatgcagactgtggaaataactaaacatgccgtcgatatcgaggagaaaggagtacgcctcagactgacaatagtggacactccaggattcggagatgcagtgaataatactgaatgctggaaaccagtagcagaatacatagatcagcagtttgaacagtatttcagagatgaatcggggctcaacaggaaaaatatacaggacaatcgcgtgcattgctgtctctatttcatctctccattcggacatggactgcggcccctggatgtcgaattcatgaaagccctgcatcaaagggtaaatatagtcccaattcttgctaaagcagatactctgacaccaccagaagtcgatcacaaaaaaagaaaaatacgggaagaaattgaacacttcggaataaaaatttaccagtttccagattgtgattccgatgaggacgaggatttcaaactccaggatcaggctttaaaagaatctatacccttcgctgtgataggaagtaacacagtggttgaagcacgcggaagacgagtgcgagggcgactgtatccatgggggattgtagaagtagaaaaccctggacattgtgattttgtcaaattaaggactatgttagtacgaactcatatgcaggatctgaaagatgtgacacgagaaactcattatgagaattacagggcccaatgcatacagtctatgacaaggctcgtagtgaaagagcggaaccgaaacaaattaactcgagaatctgggacagatttcccaatccctgccgttcctcctgggactgatcccgaaacagaaaaactgatccgggaaaaagacgaagaacttcggcgtatgcaggaaatgctgcacaaaatacaaaaacagatgaaggagaattat

SEQ ID NO: 32589 - DNA, 1434 bp, Artificial Sequence
  Description of Artificial Sequence: Synthetic coding sequence
atggatcgaagtcttggatggcagggcaactctgtgccagaagatcgcactgaggccggaattaagcggttcctggaggacaccaccgatgacggagagttgtccaagttcgtcaaggacttcagcgggaacgcatcctgccatccgcccgaggctaagacgtgggcatcaagaccgcaggtgccggaacctcgtccacaggcgccagacttgtatgatgacgacctcgaatttcgtccaccgtcaaggccgcaatcatcggacaatcagcagtatttctgcgctccggccccactctcaccgtcggccaggcctagaagcccgtggggaaagctggatccttacgactcatccgaagatgataaagaatacgtcggatttgctaccctgccgaaccaggtacaccgcaagtccgtgaagaagggatttgacttcactctgatggtggccggggagtccggtcttggtaagtcgaccctggttaactccctctttctgactgatctttaccgcgacaggaaactcctcggggccgaggaacgaatcatgcaaaccgtggaaatcacgaagcatgcggtggacatcgaagagaagggcgtgcgcctccggctgaccattgttgatactccaggattcggagacgctgtgaacaataccgaatgctggaagcccgtcgcagagtacatcgatcagcagttcgaacagtacttcagagacgaatcgggtctgaacagaaagaatattcaagacaaccgcgtgcactgttgcctctacttcatctcgcctttcggccatggacttcgccccctcgacgtagaattcatgaaagcacttcatcagcgcgtgaatatagtgccgatcctggccaaagcggacaccctcactccaccggaagtcgaccacaaaaagcgaaagatccgggaagaaatcgagcattttggcatcaaaatctaccagtttcccgattgcgactccgacgaggatgaggatttcaagctgcaggaccaagccctgaaggaatctatcccattcgcagtgatcgggtccaatactgtcgtcgaagcgcggggccgtcgggtgcgcggccgcctgtacccttggggaatcgtcgaggtggagaacccgggacactgtgacttcgttaagctgcggaccatgcttgtgcgcactcacatgcaggacctgaaggatgtaactcgcgagacgcactacgagaactaccgtgcccaatgcatccaaagcatgacccgcctggtcgtgaaggaacggaacaggaacaaactgactagagaatctggcaccgatttccctatccccgcggtgccacctgggactgatccggaaaccgagaaattgatccgggaaaaagatgaggaactgcgccggatgcaagagatgttgcacaagattcaaaaacaaatgaaggagaattac

SEQ ID NO: 32590 - DNA, 1434 bp, Artificial Sequence
  Description of Artificial Sequence: Synthetic coding sequence
atggataggtctttgggatggcagggtaacagcgtgccggaggacaggactgaggccgggatcaaacggttccttgaggatacaacagatgatggggagttgtctaaattcgtcaaggactttagtggtaatgcaagctgtcaccccccagaggcaaaaacctgggcttcacggcctcaggttcctgagccaagacctcaggctcccgacctgtatgatgacgatctggaattccgaccgccatctaggccacagagctcagataaccagcagtacttttgcgctcctgctccactctcaccaagcgcccgaccccggtccccttggggcaaactggacccttacgattcttctgaggatgataaagagtacgtcgggttcgctacccttcctaatcaggtacaccgaaagtccgtgaagaagggattcgacttcaccctcatggtcgccggggagagcggtctcggaaaatctactttggtcaattccctgttcctgactgacctttacagagacagaaaactgctgggcgctgaggaaaggatcatgcagacagtggaaataaccaagcacgccgtggacatagaggaaaagggtgttaggctgcgcctgactatcgtagacactccagggttcggagatgcggtgaacaataccgagtgctggaagcccgttgctgaatacatcgaccaacagttcgaacagtactttcgcgatgaatctggattgaatcggaagaacatacaggataaccgagtccactgttgcctgtatttcatttcccctttcggccacggcctgcgccctctggatgtggaattcatgaaggccctgcaccagcgggtcaacattgtgcctattttggccaaggccgacacacttactccgccagaggtggatcacaaaaaacgcaaaatccgggaggagattgaacattttggtatcaagatttaccagtttccggactgcgactccgatgaggatgaggacttcaagttgcaggaccaggcccttaaagaatcaatcccttttgctgttattggatctaataccgtggtagaggctagagggcggcgagtgagggggcggctttacccttggggaattgtggaggtcgaaaacccggggcactgcgattttgtgaaactgaggacgatgctggttagaactcacatgcaagaccttaaggatgtgaccagagaaacacactacgaaaactacagggctcagtgtattcaaagtatgacccggcttgtggttaaggaacgcaataggaacaagctcacacgggaatcaggaacagatttccctatccccgccgtgccgccaggtacagacccagagacggagaagttgattcgggagaaagacgaggaactgcggaggatgcaagaaatgttgcataaaattcagaagcagatgaaagaaaactac

SEQ ID NO: 32591 - DNA, 1434 bp, Artificial Sequence
  Description of Artificial Sequence: Synthetic coding sequence
atggatcgctcattgggctggcagggtaactcggtgcctgaggacaggactgaagccggtatcaagaggttcctggaagataccaccgacgatggtgagctgagcaaatttgtgaaggactttagcggcaacgcatcctgccacccgcctgaagctaagacctgggcttcgcggccgcaggtgcccgaacctcgcccgcaagcgccggacctctacgatgacgatctggaattccgccctccgtcgcgccctcagagctcagacaaccagcaatacttctgcgccccggcaccgttgtcgccttctgcccgtccacggtccccgtgggggaagctggatccgtacgactcgtcagaggatgataaggagtacgtgggatttgctacccttccgaaccaggtccatcgcaagagcgtgaagaagggctttgatttcaccctgatggtggctggagagtctggactgggaaagagcactctcgtgaattcgctcttcttgacggatttgtatagagatcggaagctgctgggcgcggaagagagaatcatgcagaccgtggagatcactaaacacgccgtggacattgaagagaagggagtgcgactccgcttgacgattgtggacactcctggtttcggagatgctgtgaacaacacggaatgctggaaaccggttgcggagtacatcgatcaacagttcgaacagtacttccgcgacgagtcgggactgaatcgcaagaacatacaggataacagagtgcactgctgcctgtactttatctcaccattcggccacggcctgcggccactggacgtcgaattcatgaaggcccttcaccagagagtcaacatcgtgcctattctcgccaaggcagataccctcaccccgcccgaggtcgaccacaaaaagcgcaagatccgcgaagagatcgaacactttggtatcaaaatctaccagttcccggattgtgactctgatgaggacgaggacttcaagctccaggaccaggcactcaaggaatcgatccctttcgccgtgatcggatcaaataccgtggtggaagcacggggcaggcgggtgcggggcaggctctacccatgggggatcgtggaagtcgaaaatccgggtcactgcgacttcgtgaagctgcgcactatgcttgtcaggactcatatgcaggatctgaaagacgtgacccgggaaacgcactacgaaaactacagagctcaatgtatccagtcaatgactcggctggttgtgaaagaaaggaatcgcaacaaattgacccgtgaatccggcactgatttcccgatcccagccgtccctcccggaactgatcccgaaactgagaagctgatcagagagaaagatgaggagctgcgcagaatgcaggaaatgctgcacaagatccagaagcaaatgaaagaaaactac

SEQ ID NO: 32592 - DNA, 1434 bp, Artificial Sequence
  Description of Artificial Sequence: Synthetic coding sequence
atggatcgaagcttgggctggcagggaaactccgtgcccgaggaccggaccgaggccggcataaaaaggttcctcgaagacactacagacgacggggagttatccaaatttgtgaaagatttttctggtaatgcctcctgtcatcctcccgaagccaagacctgggcatctcgccctcaggtcccggagcctcggccccaagcccccgatttgtacgatgacgatctggagttcagacctccgtccagaccccagtcaagcgacaaccagcagtacttttgtgcaccagcaccattgagtccgtcagcacgtcctcgctccccatggggaaaactagacccttacgatagtagcgaagacgataaggagtatgtgggcttcgccacgctgccaaatcaagtccaccgtaagtcagttaagaagggattcgattttacactcatggttgcgggtgaatcgggattggggaagtccaccctcgtcaattccctctttctgactgacctgtatcgcgacagaaaacttctcggtgccgaggagagaatcatgcagactgtggaaatcacaaagcatgctgtggatatcgaggagaagggggtgagattgcggctcaccatcgtggatacgcccgggttcggagatgctgttaataacactgaatgttggaagcctgtcgctgagtatatcgatcagcagttcgagcagtactttagggatgaaagcgggctgaatcggaaaaacattcaggataatcgcgtgcactgctgtctttactttatttctcctttcggtcatggactgcgtccactggacgtagagtttatgaaagccctgcaccagagggtaaacattgttcccatattggcaaaggcggacacattaacccctccggaggtggaccataaaaagaggaagatcagagaggaaatagagcattttggcattaagatctaccaatttccagactgcgacagcgacgaggatgaggattttaaactccaggaccaagcccttaaagaatccataccatttgctgtcatcggtagcaatacagttgtggaagcccgcggaagaagagtgcgcggtcgactgtacccatggggcatcgtggaagtcgagaatccgggacactgcgattttgtgaagctgaggacgatgctcgtgcgaacccacatgcaggatcttaaggatgttacgcgcgagacgcattacgagaactacagggctcagtgcatccagagcatgaccagactggttgtaaaggaacgaaacagaaacaaactcacgcgtgagagcggaactgatttccccattcccgcagtccccccaggcaccgaccctgagacggaaaagctgatccgtgagaaggatgaagagctccgcagaatgcaggagatgcttcacaagatacaaaagcagatgaaagagaactat

SEQ ID NO: 32593 - DNA, 1434 bp, Artificial Sequence
  Description of Artificial Sequence: Synthetic coding sequence
atggaccggtccctcggctggcagggcaacagtgttccagaggaccggacagaggctggaatcaaacggttcctggaggataccactgacgatggggagctttccaagttcgtgaaggacttctcggggaatgcgtcctgccacccacctgaagctaagacttgggcttccaggccgcaggtgccagaaccgagaccacaagccccggacttgtacgacgacgatctggagttccgacctccttcacgtccacagtcctcagacaatcagcagtatttctgtgccccggctcccctgagtccatctgctagaccacgcagtccatggggaaagctggatccctatgacagttccgaagatgacaaggagtatgttgggttcgccaccctgccgaatcaagtccataggaagtcggtgaaaaagggcttcgattttaccttgatggtcgcaggagagagtggcctggggaaatcaacccttgtgaattcattattcctcactgatttataccgcgatcgtaaactcttaggagcagaagaaagaattatgcagacagtggaaataaccaaacacgccgtcgatatcgaagagaagggcgtgcgcctgaggctgaccatagttgacacccctgggttcggtgatgccgtaaacaataccgagtgctggaagcccgttgccgagtacatagatcaacaatttgagcaatacttccgagacgagtctggactgaacagaaaaaacattcaggacaatcgagtacactgctgtctttactttatctcccctttcggtcacgggctgcgcccactggatgtagaatttatgaaagccctgcaccagcgggttaatatagttcctattcttgcaaaagccgacaccttgaccccaccagaggtagatcataagaagaggaaaatcagagaagagatcgagcattttgggatcaagatttaccagttcccagactgtgatagtgatgaggacgaagacttcaagctccaggaccaagccctcaaagagtctatcccgttcgctgtaattggttcaaacacagtcgttgaggctcgtggtcgtcgggttcggggccgtctctacccctgggggattgtggaggtcgagaatccaggccactgtgacttcgtgaagctgcggactatgcttgtccggacccacatgcaagatctcaaagacgtgacacgcgagacccactatgagaattaccgcgcacaatgcatccagagcatgactagactagtggtaaaggagcgcaatcgtaacaagttgacccgagagagcggaactgatttcccaatcccggcggtacctccgggcactgaccccgaaacagaaaagctcatccgggagaaggacgaggaactgaggaggatgcaggagatgttgcataaaatccagaagcagatgaaagaaaattac

SEQ ID NO: 32594 - DNA, 1434 bp, Artificial Sequence
  Description of Artificial Sequence: Synthetic coding sequence
atggacaggagcctcggatggcaggggaactcggtgccggaagatcgcacggaggcaggcatcaagcggtttctggaagataccactgacgatggggagctgtccaagtttgtgaaggatttctcaggtaacgcctcttgccaccctccggaggccaagacatgggcttctcggcctcaggtgccagaaccaagacctcaagcacccgatttatacgacgatgacttggagtttcgaccaccatcaaggccccagagtagtgataaccaacagtatttttgcgccccagctcccctaagccccagcgcgagaccccgatctccctggggcaagctggacccctatgacagcagtgaagacgacaaagaatacgtgggtttcgctacgctgccgaatcaagtgcatcgcaaatctgtcaagaaggggtttgacttcaccttgatggtagccggtgagtcagggcttggtaagagtaccctcgtgaactccttgttcttgaccgatctgtatcgggaccggaaactgctgggtgcggaggagaggattatgcagacagtggaaattactaaacacgctgtggatattgaagagaagggagtgaggctgcggcttactattgtggatacccccggctttggggacgccgtgaacaataccgagtgctggaagcctgtggcagagtatatagaccaacagtttgaacaatacttccgagatgaaagcggtctgaatcgcaagaacatccaagacaaccgcgtccattgttgcctgtattttatcagtccgttcggacacgggttgagacctctggatgtggagttcatgaaagccctccaccagagggtcaacatcgtccctattctcgccaaggccgataccctgacaccccctgaagtggatcacaaaaaacggaaaatacgcgaagagatcgagcacttcggcatcaagatatatcagttcccggactgtgattccgacgaggacgaggactttaaattacaggaccaggcgcttaaggaatctatcccttttgctgtgatcggatcgaatacggttgtggaggctcgaggccgcagggtaaggggcagactctatccctggggcatcgtagaggttgaaaatcccgggcactgcgacttcgtgaaactgagaactatgctcgtgaggacacacatgcaagatttaaaggacgtcaccagagaaacccactatgaaaattaccgggcacaatgcatacaaagtatgacgaggcttgtggttaaggagaggaaccgcaacaaactgacgcgggaaagtggtaccgactttcctatccctgctgttccgcccggcacggatccggaaactgaaaagctgattcgcgaaaaggacgaggagctccggaggatgcaggaaatgttgcacaagatccagaaacagatgaaagagaattac

SEQ ID NO: 32595 - DNA, 1434 bp, Artificial Sequence
  Description of Artificial Sequence: Synthetic coding sequence
atggacaggtcattgggctggcaaggaaatagtgtgcccgaagatcgtaccgaagcaggtattaagcgcttcctggaggacactactgacgatggcgaactgagtaagttcgttaaggacttctcgggcaatgcctcctgccatcctcctgaagccaaaacctgggccagtaggccccaagtcccagaaccacggccccaggctcctgatttatatgacgacgacctggagtttcggcccccaagtcggccgcagtcttccgataaccagcagtacttctgtgcacccgcccctttgagcccatcagcaagacctcgatctccctggggaaaactggacccctatgatagcagtgaggatgacaaggagtatgtgggcttcgctactctgcccaatcaggtgcatcgtaagtcggtgaagaaagggttcgactttacacttatggtcgctggggaaagcggactggggaagagtactctggtgaattccctattcttgacagacctgtatcgcgaccggaagctgctgggcgctgaagagagaatcatgcagacagtggagatcaccaagcatgcagtggatatcgaggagaaaggggtaagacttcggttgacgattgtggacacgccagggttcggcgatgccgtgaataatacagagtgttggaaacccgtagcggaatacatcgaccagcagtttgaacagtatttccgagatgagtccggactcaatcgcaaaaacatccaggataaccgcgtgcactgctgcttgtactttatcagtccctttggtcatggattgagacctctcgatgtcgagtttatgaaggccctgcatcagcgtgtgaacattgtgcccattcttgccaaggccgatacccttactcccccagaggtggatcataagaagagaaaaattcgcgaggagattgagcacttcgggatcaaaatctaccagttcccggactgtgactcagacgaggacgaggatttcaagttacaagaccaagccctaaaagaaagcatcccattcgcggtaattggtagcaacaccgtggtggaagcccgcggacgtagggtcagagggcgcctatacccctggggaattgtagaggtcgagaatccaggccattgcgacttcgttaagcttcgcactatgttggtgcgtacccatatgcaggatcttaaggatgttacacgtgaaactcactatgagaattaccgcgctcagtgtatccagagcatgacaaggctggtcgtgaaggagcgcaacaggaataaattgacacgggagtctggtacagatttcccgatcccagctgtgcccccaggcaccgatccagagactgaaaaattgattcgggaaaaggacgaagagctgaggcggatgcaggaaatgctccacaagatacaaaaacagatgaaagaaaactac

SEQ ID NO: 32596 - DNA, 1434 bp, Artificial Sequence
  Description of Artificial Sequence: Synthetic coding sequence
atggacaggagccttggttggcagggaaacagtgtgccagaagacagaacagaagctggaattaagcgttttctcgaagatacaaccgacgatggtgagcttagcaagttcgtcaaagacttcagcggtaatgcaagttgccacccaccagaggctaagacttgggccagccgccctcaggtacccgaaccacgtcctcaggctccagatctctacgatgatgacctggagtttcgtccacctagccgccctcagtcctcagacaaccagcaatatttctgtgcccctgcaccattgagcccatccgcacgtccacgctccccctggggtaaactggacccctatgacagtagcgaggacgacaaagaatatgttggcttcgcaaccctgcccaaccaagtccataggaaatcagttaaaaagggattcgattttaccctgatggtggccggtgagtccggcctgggcaagagcacccttgtaaactctctttttctcactgatctctaccgtgatagaaaactcctcggagcagaggaacgcattatgcaaacagtggagattacaaaacacgccgtggacattgaggagaagggtgtccgcctgcgcctgaccatagtcgatacacccggatttggtgatgctgtcaacaacactgagtgttggaagcctgtggctgagtacattgatcaacagttcgaacaatatttccgtgatgagtctggtctgaacaggaagaacatccaagacaacagagtccattgttgcctgtattttatcagccccttcggacacggcttgaggccactggatgttgagttcatgaaagctctccatcagagagtaaatatcgttcctattttggctaaagctgatacattgaccccccccgaggtcgatcacaagaagcgtaagatacgtgaggaaatcgagcacttcggaattaagatttaccagtttcccgattgcgactctgacgaggatgaggatttcaagctccaggaccaggctctcaaggaatctatccccttcgctgtcattggcagtaataccgtggtcgaagctagaggacgccgcgtccgcggccgcctttacccatggggtattgtggaggtagaaaaccccggacactgcgactttgtgaaactgaggactatgttggtgaggacccatatgcaggacctcaaagacgtcacccgcgagacacactatgagaactatcgcgcacaatgcatacagtctatgacaagactggttgtgaaggaacgtaatagaaataaattgacccgcgaatccggaacagacttccctatacccgcagtgcctccaggtaccgatccagagactgaaaagctgatcagggagaaagacgaggagctgaggaggatgcaagaaatgctgcataaaatacagaagcagatgaaggagaattac

SEQ ID NO: 32597 - DNA, 1434 bp, Artificial Sequence
  Description of Artificial Sequence: Synthetic coding sequence
atggacaggtcccttggatggcaaggcaatagcgtgccggaagatagaaccgaagcaggtataaagagatttctggaagataccactgatgatggcgaactttccaaatttgtgaaggacttttcggggaacgcatcctgtcatccgccagaggcaaagacttgggctagtagacctcaagtgcctgagccgcgtcctcaggcaccagacctctacgacgacgaccttgagtttaggccacctagccggccacaatcatccgataatcaacaatacttttgtgccccagcaccccttagcccttccgctcgcccaagatccccatgggggaaacttgatccctacgattcgtcagaggacgacaaggaatacgtcggatttgctaccctgcctaaccaagtgcatagaaaatccgtgaaaaagggttttgactttactctgatggtcgcaggagaatcgggtcttggcaagagcacgctcgtcaattccctttttctgaccgacctttaccgggataggaagctgctgggtgctgaggaaagaatcatgcaaaccgtcgaaattaccaagcacgccgtcgacattgaagagaagggtgtgcgactccgactcaccattgtggataccccaggattcggagacgcagtgaacaacactgaatgctggaagcctgtggcagaatacattgatcagcaattcgaacagtactttagagacgagtcaggactcaacaggaagaatatacaggataaccgcgtgcactgttgtctgtactttatctccccatttgggcacggcctgaggcccctggatgtggagttcatgaaagcacttcaccaacgagtgaacatcgtgccaattctcgcaaaggctgacactcttactcctcctgaagtcgaccataagaagcgcaaaattcgggaagagattgagcatttcggaataaagatttaccaatttccggattgcgattcagatgaggatgaggactttaaactccaagatcaggcactgaaagaatccattcccttcgcagtgatcggatcgaataccgtcgtcgaagcgcgcgggagacgcgtgcgaggacggctgtacccctggggcattgtcgaggtggaaaaccccggccattgcgactttgtcaaactgcgaactatgctggtccgtacccatatgcaagatctgaaggatgttactagggagactcattacgagaattacagggcacaatgtatacaatctatgactcggcttgtggtgaaggaaaggaaccgtaacaaactgacccgtgagagcggcactgactttccaataccagccgtgccacctggaaccgatccagagactgagaaactgatcagagaaaaggatgaagagcttcgtagaatgcaggaaatgctgcataagatacagaagcaaatgaaggaaaactac

SEQ ID NO: 32598 - DNA, 1434 bp, Artificial Sequence
  Description of Artificial Sequence: Synthetic coding sequence
atggaccgctcgttgggatggcagggaaattcagtgccagaggaccgcactgaagctggcatcaaacgcttcttggaggatactaccgatgatggagagctgtcaaagtttgtgaaagacttctcgggtaacgcttcctgccaccccccggaagccaagacttgggccagccgcccacaggtcccggaaccaagaccacaggcccctgacctttacgatgatgatctggaattccgacctccgagcagaccacagagctcggataaccagcagtacttttgtgcgccggcacccctgtcaccgtcagctagaccacgcagcccgtggggaaagctggatccctacgattcgagcgaggatgacaaggagtacgtgggatttgccaccctcccgaatcaggtgcacaggaagtcggtcaagaagggattcgacttcaccctgatggtggccggagaaagcgggctggggaaatcgactctggtcaactcgctgtttctcactgacctctaccgcgatcgcaaactgctgggagcggaagaaagaatcatgcaaaccgtcgaaatcacgaagcatgccgtggatatcgaagaaaagggtgtcaggctgcggcttaccatcgtggacaccccgggatttggcgacgccgtgaacaatactgagtgctggaagcctgtggctgagtacatcgatcaacagttcgaacaatactttcgggacgagtcgggcctgaacagaaagaatatccaagacaatcgggtgcactgctgcctctactttatctcgccctttgggcatggactgcgcccgttggatgtggagtttatgaaggctctgcatcagcgcgtgaacattgtgcccattctcgcgaaggccgacacccttaccccacctgaggtggaccataagaagcgaaagatcagggaggagatcgaacacttcggaatcaaaatctaccagttcccggactgcgattccgacgaggacgaggacttcaagctgcaggatcaggcactgaaggaatctatcccgttcgcagtgatcggctcgaacaccgtcgtggaagcacgcgggcggagggtgcggggccggctgtacccctggggaatcgtggaggtggagaacccgggacactgcgactttgtgaaactccgtaccatgctggtccggacccacatgcaggatctgaaagatgtgacccgcgaaactcattacgaaaactaccgcgctcagtgcattcagtccatgacgcggctggtggttaaagaaagaaatcgcaacaaactcacccgggagtcaggcactgattttccgattcccgccgtgcctccaggtactgatccagagacggagaagctgatccgcgaaaaggacgaagagttgcggcggatgcaggagatgctgcacaagatccagaaacaaatgaaggaaaactac

SEQ ID NO: 32599 - DNA, 1434 bp, Artificial Sequence
  Description of Artificial Sequence: Synthetic coding sequence
atggatcgttcccttgggtggcagggaaatagtgtgcctgaagaccgaacagaggccgggatcaaacgattccttgaggacacgacagatgacggggaactgtctaaatttgtcaaggacttctcagggaatgcatcctgccaccccccagaggccaagacatgggcttcaaggccccaggtgcccgaacccagaccccaggcccctgatctatatgatgatgacctggaatttcgccctccttctaggccacagtcgtctgataatcagcaatatttctgcgccccggcccctctgtcgcccagcgcccgacccaggtccccctggggcaagttagatccatacgactctagcgaggacgacaaggagtatgtagggttcgccacgctgcctaaccaggtgcatcggaagtcggtcaaaaagggcttcgattttactctgatggtggctggggaaagcggactgggcaaatccacactggtgaattctcttttcctgaccgacctgtacagagatcgcaagttgctgggtgcggaggagcggattatgcagaccgtcgagattacaaagcacgcagtggatatcgaggaaaagggggtccgcttgcgtctgactatcgttgacactcctgggttcggagatgcagtgaacaacacagaatgctggaagccggtggccgaatacattgaccagcaatttgagcagtatttcagggacgaatctggtctcaatcggaagaacatccaggataacagggtgcactgttgcctgtacttcatttcaccctttgggcacggcctacggcctttggatgtggagttcatgaaggcactgcatcagcgtgtgaatattgtcccaatcctagcgaaagcggacactttaaccccccccgaggtcgatcacaaaaagagaaaaatacgcgaagagattgagcacttcggaattaaaatatatcagtttccggactgcgactccgacgaggatgaggactttaagctccaggaccaagcactgaaagagtccataccgtttgccgtcatagggtctaacacagtagtggaagccagagggaggcgggtgcgcggccgcctgtacccatgggggatagtggaagtcgagaatccaggtcactgcgatttcgtcaaattacggaccatgttggtccggactcatatgcaagatctcaaggatgtaactcgtgaaacccattatgaaaactatcgcgctcagtgcatacagtccatgacccgcttggtggtcaaagagcgcaaccgcaataagctaaccagggagagtggcacagacttcccgatcccagccgtccctcctggaactgaccctgagacggagaagctaattagagagaaagatgaggagctgagacggatgcaggagatgctccacaaaattcagaaacaaatgaaggaaaactat

SEQ ID NO: 32600 - DNA, 1434 bp, Artificial Sequence
  Description of Artificial Sequence: Synthetic coding sequence
atggatcggtcgctgggctggcagggcaatagcgtccctgaggaccgcaccgaggcaggaatcaagcggttcctggaggacaccactgatgatggagagctgagcaagttcgtgaaagacttctcaggcaacgcttcctgccatcccccagaagccaagacgtgggcgagcaggccgcaggtgccggagccacggccacaagctccggacctttacgatgacgacttggaattccggccgccgtcgcgcccacagtcctcggataatcagcaatacttctgcgcgccggcccctctctcccctagcgcaaggcctcgcagcccgtggggaaaactggacccctacgactcgtcggaggatgacaaggaatacgtgggatttgccactctcccgaatcaggtgcaccgcaagtcggtcaaaaagggtttcgattttactctcatggtcgcaggggaatccggactggggaagtcaacgttggtgaactctctgtttctcaccgatctgtaccgggatagaaagctgctgggagctgaggagagaataatgcagactgttgaaatcactaagcacgccgttgacatcgaagaaaagggagtccgtctccggctgaccatcgtggatactccaggatttggcgacgcggtcaacaacacggaatgctggaaaccagtggcggaatacatcgatcagcaattcgagcagtacttccgcgatgagtcaggactcaaccgaaaaaatatccaagacaaccgcgtgcactgctgcctgtacttcatctccccttttggtcatggcctgaggccactggacgtggaattcatgaaggccctgcatcagagggtgaatatcgtgccgatcctggccaaagccgataccctcaccccaccggaagtggaccataaaaagcgcaaaattcgcgaagaaatcgaacactttggaattaagatctaccaattccccgactgtgacagcgacgaggatgaggacttcaaactccaagaccaagcgctcaaggagtccattccattcgccgtgattggttccaacactgtcgtggaagctagaggacgccgggtccgcggcagactgtatccctgggggatcgtggaggtggaaaacccgggacattgcgacttcgtaaagctgcggaccatgcttgtgcgcacccacatgcaggacttgaaggatgtcaccagagagactcactatgaaaactacagagcacagtgtatccagtcgatgactaggctcgtcgtgaaggaaagaaatcggaacaaacttactcgcgaatcagggaccgatttccctatccctgccgtgccgccgggcaccgacccggaaaccgaaaagttgatccgagagaaggacgaagagctgcggcggatgcaagagatgcttcacaagatccagaagcagatgaaggaaaactac

SEQ ID NO: 32601 - DNA, 1434 bp, Artificial Sequence
  Description of Artificial Sequence: Synthetic coding sequence
atggaccgttcgttgggatggcaaggcaatagcgtgcccgaagaccgcacggaggccgggatcaagaggttcctggaggacactactgacgacggcgaacttagcaagtttgtcaaggatttttcgggcaacgcttcctgccacccacctgaagccaagacctgggcatcgcgcccccaggtgcccgagccaaggcctcaggctcctgatttgtatgacgatgatctggagtttcgcccgccgtcccgccctcaatcctctgataaccagcagtacttctgcgctccggcccccctgtcgccctctgctcggccgcgttctccgtggggaaaactggacccttacgattccagcgaagatgataaggagtatgtaggttttgccacgctcccgaatcaggtccacaggaagagtgtgaagaaaggctttgatttcactctgatggttgctggcgaaagtggcctaggcaagtcgaccctggtgaacagcctgttcttaacagatctgtatcgagatcggaagctcctgggggcggaggagaggattatgcagaccgtcgaaattaccaagcacgcggtagatatcgaagagaaaggtgttagattgcgcctgacaatcgtcgacacccccgggttcggagacgctgtcaacaacaccgaatgttggaagccggtcgcagagtatatcgatcaacaatttgaacagtattttcgcgacgaaagcggattaaatcgcaagaacatacaagataatcgcgtgcactgctgtctttactttattagccctttcgggcatggactccggccgcttgatgtcgaattcatgaaagctctgcaccagcgggtgaacatcgtgccgatattggccaaggcggataccctgacgccgccagaagtggaccacaagaagcgaaagatcagagaagaaatcgaacacttcggcattaagatctaccaattccccgactgtgatagcgacgaggatgaagattttaagctgcaggatcaagcactgaaggagagtattcccttcgccgtgatcggatctaatactgtcgtggaagcgcgtggtcgtcgagtccggggacgcctctacccgtggggcatcgtggaggtggaaaacccgggtcactgcgattttgtgaaactccgcactatgctggtgagaacccatatgcaagacctcaaagatgtcacacgcgagacgcactacgagaactaccgcgcgcaatgtatccagtcgatgacacgactggtcgtgaaggagcgaaacaggaacaagctcacgcgcgagtcgggtaccgatttcccgatacccgcagttccgcctggaacggatccggaaactgaaaaactaatacgtgaaaaggacgaggaacttcgacgcatgcaggagatgcttcacaaaatccagaagcaaatgaaagagaactac

SEQ ID NO: 32602 - DNA, 1434 bp, Artificial Sequence
  Description of Artificial Sequence: Synthetic coding sequence
atggatcgctcactgggatggcaaggcaattcggtgcccgaagatagaaccgaggcgggaatcaaaaggttcctggaagatactactgacgacggcgaactgtccaagttcgtcaaggatttttcgggaaacgcctcgtgccatccaccagaagcaaagacctgggcgtcgcggccccaggtcccggagccgcgcccgcaagctccagatttgtacgacgacgatcttgagttccggccaccgtcgcgtccgcaatcgtccgataatcaacagtatttctgcgcaccggccccactctccccctccgctcgcccacgctcaccgtggggaaagctggatccgtatgatagctcggaggacgataaggaatacgtcggatttgccaccctgcccaatcaggtccacaggaagtccgtcaagaagggcttcgacttcactctcatggtggctggcgagagcggactcggaaagtcgactctcgtgaattccctctttctcactgacctgtaccgcgatcggaagctgctgggagcggaagagagaatcatgcaaaccgtggagatcaccaagcatgcggtcgatatcgaagagaagggagtgcggctgcggcttactatagtggacaccccgggattcggggacgcagtgaataacaccgaatgctggaagccggtcgcggagtatattgaccaacagttcgaacagtacttccgcgacgaatccggacttaacaggaagaatattcaggataatagggtgcactgctgcctgtacttcatttcccctttcggtcacggcctgaggcccctggatgtcgagtttatgaaggccctgcatcaaagggtgaacatcgtccctattttggccaaggccgacactctgactccgcccgaagttgatcacaagaagcggaaaattcgggaagagatcgaacacttcggaatcaagatctaccaattcccggactgtgactccgatgaagatgaggacttcaagttgcaggatcaagccctcaaagaatccatcccgttcgcagtcatcgggtctaacacggtcgtcgaagctaggggacgacgcgtgcggggacgcctctacccgtggggaatcgtcgaggtggaaaatccaggacactgcgactttgttaagctgcgcaccatgctcgtccgcacgcacatgcaggacctgaaggacgtgacccgagagactcattacgagaactacagagcccaatgcatccagtcaatgactcgcctggtggtgaaggagcgcaacaggaacaagctgacccgggaatcgggtaccgactttccaatcccggcggtgccgccgggaacggacccggaaaccgaaaagctgatccgggagaaggacgaagagctccggagaatgcaggagatgctgcacaagatccagaagcagatgaaagaaaactac

SEQ ID NO: 32603 - DNA, 1434 bp, Artificial Sequence
  Description of Artificial Sequence: Synthetic coding sequence
atggaccgctccctgggttggcaaggcaacagcgtgccagaggaccgcactgaggcgggtattaaacgcttcctggaagacacgacagacgacggtgaattgtccaagttcgtgaaggatttcagcggcaacgcttcttgccaccctccagaagcgaagacttgggccagccgccctcaagtgcctgagccacgtcctcaggctcctgacctgtatgatgatgacctagaattccgccccccgagccgcccccaaagcagcgacaaccaacagtacttctgcgctccagcaccactgagcccaagcgctcgcccgcggtccccatggggtaagttggacccatacgatagctcagaagatgacaaggaatatgtggggtttgcaaccctgcctaatcaagttcatcgtaaatctgtgaagaagggttttgattttactctcatggttgccggcgaatccggtctgggtaaatccaccttagtgaactcactgttcctaacggacctctaccgcgatcgcaaactgctgggtgcagaagaacgcatcatgcagacggtggaaattacgaaacacgccgtggacatcgaggagaagggtgttcgcctgcgattgactattgtggacactccgggattcggagatgcggttaataataccgagtgttggaaaccggtggcggaatatatcgaccaacaattcgaacaatactttagggatgagtctggcctaaatcgcaaaaatatccaagacaatcgcgtgcactgttgcctttactttatttcgccgtttggccacggcttaaggccactggacgttgagttcatgaaagccctgcaccagagagtcaacattgtaccgatcctggccaaggccgatacgctcactcctccggaagtggaccacaaaaagcgcaagattcgggaggaaattgagcacttcgggatcaaaatataccagttccctgattgtgacagcgatgaagacgaggactttaagctgcaggatcaagcactgaaggagagcattcctttcgcagtgattggcagcaacaccgtcgtcgaagcacgtgggcgtcgtgtcagaggcaggctgtatccgtggggtattgtggaggtcgagaacccaggtcactgcgacttcgttaaactgagaactatgctggtgcgcacacacatgcaagatctgaaggatgtgacccgtgagacgcattatgagaactacagagcacagtgtatccagtctatgactcgcctggtagtcaaagaacgcaacaggaacaagttgacccgcgagagcggtaccgatttcccaattccggcagttcctccgggtaccgatccggaaacggaaaagctgattcgtgagaaggatgaggagctacgccgaatgcaggaaatgctgcataagattcagaagcagatgaaggagaactac

SEQ ID NO: 32604 - DNA, 1434 bp, Artificial Sequence
  Description of Artificial Sequence: Synthetic coding sequence
atggatcgatcccttggatggcaaggaaattccgtgccagaggataggactgaggctgggattaagcgatttctcgaagataccactgatgatggagaactctcgaagttcgtgaaggacttttccggaaatgcaagctgtcacccaccagaagcaaagacctgggcaagcaggccacaggtgccagaacctcgaccacaagcacctgacctttacgatgatgaccttgaatttagacccccgagccggcctcagtcatccgacaaccagcagtacttttgcgcacctgcacctctctccccttcagctagacctagatccccctggggcaagctcgacccatacgattcaagcgaagatgataaggaatacgtcggtttcgcaactctgccaaatcaggtgcacaggaagtcagtgaaaaaggggttcgatttcacgcttatggtggccggtgaaagcggactgggaaagtcgactcttgtcaactccctctttctgaccgatttgtacagagatcgaaaactccttggagcagaagagagaattatgcaaaccgtggagatcaccaagcacgcggtcgatatcgaggagaagggtgtgagactgcggctgactattgtggatacccctggctttggcgatgcagtgaataacaccgaatgttggaagccagtggccgagtacattgatcagcaattcgaacaatactttagagacgagtcgggccttaaccgcaaaaacatccaagacaatcgggtccattgctgtttgtactttatcagcccttttggacatggactccggcctctcgatgtggaattcatgaaggctcttcatcaacgcgtgaatattgtgccaatccttgccaaagccgataccctgactccccctgaggtggaccataagaaaagaaaaatccgggaggaaattgaacacttcggcattaagatatatcagttcccagactgtgactctgacgaagatgaggactttaagctgcaagatcaggcccttaaagaaagcataccttttgccgtgattggatcaaataccgtggtggaagcgagaggccggcgagtcagggggagactttacccgtggggaatcgtggaagtggagaaccctgggcattgtgattttgtgaagctcagaaccatgctggtgagaactcatatgcaggatctgaaagacgtgacgagggaaacccactacgagaattaccgcgcccaatgtatccaaagcatgactcgcttggttgtcaaggaacgcaatcgcaataagctgactcgggaatcaggtacggattttcctatccctgcagtgccccctggaactgatcctgaaaccgagaagctgattcgagagaaagatgaagagctccggaggatgcaggaaatgctgcataagatccaaaagcagatgaaggaaaactac

SEQ ID NO: 32605 - DNA, 1434 bp, Artificial Sequence
  Description of Artificial Sequence: Synthetic coding sequence
atggatagatcgctgggctggcagggcaactctgtgccagaagatcgaacagaggcaggcatcaagcggttcctcgaagacactaccgatgacggcgagttgagcaagttcgtgaaagattttagtgggaatgcatcctgtcaccctcctgaagccaagacctgggcgagcaggcctcaagttcccgaacctcgaccacaggcccccgacctttacgatgacgacctcgagtttcgtcctccttcaagaccacagagttccgataatcagcagtacttttgtgctcctgcccctcttagccctagtgcaaggccgagaagtccttgggggaaactggatccatatgactcgtccgaggatgacaaggagtatgtaggtttcgcaactctccccaaccaggtgcacagaaagtccgtgaaaaagggctttgattttaccctcatggtcgccggggagagtggtctcgggaagtctaccctcgtgaactcgttgttcctgactgacctttatagggacaggaaattgctcggggccgaggaaaggatcatgcagaccgtggagattaccaagcatgctgtcgatatcgaggagaaaggtgtgagactgaggctgaccattgtggatactcctgggttcggagacgctgtgaacaacactgaatgctggaagcctgtagcggagtacatagatcagcagtttgaacagtactttcgagacgagtcagggctcaacagaaagaatatccaagacaatagggtgcattgttgcctatatttcatttctccttttggccacggcctgcggcccctggatgttgaattcatgaaggctctgcatcagcgagtaaatatcgttccaatcctggctaaagcggataccctcaccccccctgaggtggaccataagaaacggaaaatcagagaggagatcgagcattttggtatcaagatctaccagtttccggactgtgacagcgatgaggatgaggattttaagctccaggatcaagcattgaaggaaagtattccgttcgcagtgatcgggtcgaatacggtggttgaggctcgtggacgtagagtccgcggtcggctgtatccatggggtatcgttgaggtggagaacccaggacactgtgatttcgtcaagctgagaaccatgctcgttcgcacccacatgcaggatttgaaggatgtcacacgggagactcactacgagaattatcgcgcccagtgtattcagagcatgacccggctggtggtgaaagaaaggaaccggaacaaattgactagggaaagcggaaccgatttcccaatccctgctgttccacccggtaccgaccccgagaccgagaagcttatccgcgagaaggatgaagagctgagaagaatgcaggaaatgctgcataagatccagaagcagatgaaagagaattac

SEQ ID NO: 32606 - DNA, 1434 bp, Artificial Sequence
  Description of Artificial Sequence: Synthetic coding sequence
atggaccggtcgctgggctggcagggtaattcggtaccggaagatagaactgaggccggcatcaagcggttcctggaggacactactgacgacggggaactgtccaagtttgtgaaggatttctccggaaacgccagctgccacccacctgaggctaaaacttgggcgtccagacctcaggtcccggaaccgcgcccacaagcgcccgacctctatgatgatgacttggaattcagaccgccatcgcgcccgcagtccagtgacaatcagcagtacttctgcgctccggcgccgctgtccccaagcgcacgccccaggagcccttgggggaaactggacccgtacgatagttcggaggatgacaaagaatatgtgggattcgcgacccttcctaaccaggtgcacaggaagtctgttaagaaggggtttgatttcactctcatggtggctggagaatcaggactgggtaagagcaccctcgtcaactccctcttcctgacggatttgtaccgcgaccgcaaattgctgggcgccgaggagcgcatcatgcaaacggtcgaaatcactaagcacgccgtggatatcgaagagaagggcgtgagactgaggctcacgattgtcgacaccccggggttcggtgacgccgttaacaatactgaatgctggaaaccagtggcggaatacatcgaccaacaattcgagcagtacttccgcgatgaatccggattgaatcggaagaatatccaggataatcgggtccattgctgtctgtacttcatctcaccattcggtcatggactccgacccctggatgttgagtttatgaaggcactccaccaacgggtgaacatcgtgccgatactggccaaagcagataccctgacgccgccagaagtggaccataagaaacgcaagatcagagaagaaatcgaacactttggaatcaagatttaccaatttcccgattgcgactcggacgaggacgaggacttcaagttgcaggaccaggcccttaaggaatcaatcccattcgctgtcatcggttcaaacactgtagtggaagctcgaggaaggcgcgtgcggggcagactgtacccgtggggtatcgtcgaggtggagaacccagggcattgcgacttcgtcaaattgaggaccatgcttgtcagaacgcacatgcaggatcttaaagacgtgaccagagaaacccattacgaaaactaccgcgcacagtgtatccaaagcatgacccggctcgtggtgaaggagcggaacaggaacaagttgactagagaatctggaaccgactttccaatccccgccgtgccgccaggcaccgatcctgagactgagaagctcattcgggagaaagacgaagagctgcggagaatgcaagaaatgctgcacaagatacagaagcagatgaaggaaaactac

SEQ ID NO: 32607 - DNA, 1434 bp, Artificial Sequence
  Description of Artificial Sequence: Synthetic coding sequence
atggatcgatcactggggtggcaggggaattcggtacctgaagataggacggaagcgggcatcaagaggtttctggaagataccacagatgacggtgagctatcaaaattcgtgaaagatttttcaggtaacgcttcatgccatccgccagaggcaaagacgtgggccagcagaccccaggtcccagagccacggcctcaagcgccagacctgtatgacgacgatctcgaattcagacctccgagcaggccgcagtcctcagataatcagcaatacttctgtgccccggcaccgttgagcccatccgctaggcctcgctctccatggggtaaactggatccctacgatagtagcgaggatgacaaggaatatgtgggcttcgctacactccctaatcaggtgcatcgaaaatcggtcaaaaagggcttcgactttactctcatggtggccggtgagagtgggctcggcaagtctaccttggtgaactccctgttcctgacagatctgtacagggacagaaaactcctcggcgccgaggagcgaatcatgcaaactgtcgagattaccaagcacgctgtcgatatcgaagagaagggcgtgcggctgcggctgacaatcgtggacacccctggtttcggggatgcagtcaataacaccgagtgttggaagccagttgctgaatatatcgatcagcagtttgagcagtacttccgcgacgagtccggactgaatagaaagaacatccaggataatagagtacattgttgtctgtacttcatatccccatttgggcatggcctgcgacctcttgacgtggagttcatgaaggccctgcaccaaagggtgaatatcgtgcccatccttgcaaaggctgacactttgacgccaccggaggtcgatcataagaagcggaaaattcgggaggaaatcgaacacttcggaatcaagatctaccaatttcccgactgcgactctgacgaggatgaagatttcaagctccaagatcaggccttgaaagagagtatcccttttgctgtcattggctctaacaccgtcgtcgaagctcgaggtcgacgcgtgcgcggaagattgtacccttggggaatcgtagaagtcgaaaaccccgggcattgtgattttgttaagttgcggacgatgttggtacggacccacatgcaagatctcaaggatgtgaccagagagacgcactatgagaactaccgagcccagtgcatccagagcatgactcgcttggttgtgaaagaaaggaatcgaaataaactgacaagggagagcggaactgatttccctatacctgccgtccctcccggaactgatcccgaaacggagaaactgatcagggaaaaagatgaggagttacgaaggatgcaggagatgcttcataagatccaaaaacagatgaaggaaaactat

SEQ ID NO: 32608 - DNA, 1434 bp, Artificial Sequence; identical to SEQ ID NO: 32599
  Description of Artificial Sequence: Synthetic coding sequence

SEQ ID NO: 32609 - DNA, 1434 bp, Artificial Sequence
  Description of Artificial Sequence: Synthetic coding sequence
atggaccgatcgctgggatggcagggaaatagcgtgccagaggataggaccgaagctggaatcaaacggtttcttgaagatactactgatgatggcgaactttccaagttcgtgaaggatttttccggaaacgcctcatgtcatcccccagaggcaaagacctgggcctcccgcccacaggtgcctgagcctcggccacaagctcctgatctgtacgatgatgacctcgaatttcggcctccatcacgcccccagtccagcgataatcagcaatacttttgtgcacctgcccctctgtctccaagtgcccgaccaaggtcgccctggggaaagttggacccttacgatagcagcgaggatgataaggaatacgtgggcttcgcaactttgcctaaccaagttcatagaaagtccgtgaagaagggttttgactttacccttatggttgcaggggagtcggggctggggaagtccacccttgtgaatagcttgttccttaccgacctctatcgggatcggaaactccttggtgcggaagaaagaattatgcaaacggtggaaattaccaagcatgccgtggacatcgaagaaaagggggtgagactccggttgactattgtcgatactcccggtttcggtgatgccgtgaacaacacggaatgctggaagcccgtggcagaatacattgaccaacaatttgaacagtactttagggatgaatcgggtcttaaccgcaaaaacatacaggacaaccgggtccattgttgcctgtactttatcagccctttcggacatggtctgcggccgctggacgtggagtttatgaaggccctccatcagcgagtgaatatagtccctattctcgcaaaggcagataccctgaccccacctgaagtggaccataagaagcgcaagattagggaagaaattgagcatttcggaatcaagatttaccagttcccagattgtgacagcgatgaagatgaggatttcaaactccaagatcaagcgcttaaagaatcgattccatttgccgtcattggctcaaataccgtggtggaagcacgggggagaagggtcaggggacggctgtatccttggggtattgtggaagtggagaaccctggccattgtgatttcgtgaaattgcgaacgatgcttgtgagaactcatatgcaggatctcaaggatgtcaccagggaaactcactacgaaaactacagggcccaatgtatacaatcgatgacgcgtcttgtggtgaaggagaggaacagaaacaagctgacccgagaatcgggaacggacttccctatacccgctgtccctcctgggaccgaccccgagactgagaagctgattcgtgaaaaagacgaggaactgcggcgtatgcaggaaatgttgcacaagatacagaaacaaatgaaggagaactac

SEQ ID NO: 32610 - DNA, 1434 bp, Artificial Sequence
  Description of Artificial Sequence: Synthetic coding sequence
atggatcgtagcctgggatggcaggggaacagtgtacccgaggacagaactgaagcaggaatcaagcggtttctggaagacacaacggatgatggggagctgagcaaattcgttaaggatttcagtggtaacgcctcttgtcacccccccgaagctaaaacttgggctagccgaccacaggtgccagaaccacggccccaggcacccgacctttacgatgatgatctagaatttagacccccctctcggccccagagctcagataaccagcagtacttttgcgcccccgctcctctgtctccatctgcccgtcctcggtctccctggggaaagctcgatccgtacgactcgtctgaggatgataaagaatacgtaggctttgcaaccttgcccaatcaggtgcaccgtaagtcagttaaaaaaggcttcgattttaccctcatggtcgccggagagtcaggattaggaaagtcaacactggttaatagcctgttcctgaccgatctttatagggatagaaaactgttaggcgccgaagaacgaataatgcagactgttgaaattactaagcacgccgtggatattgaggaaaaaggcgtccggctgcgcctcaccatcgtggacactccggggtttggcgatgctgttaataacaccgaatgttggaaaccagtggcggagtacattgaccaacagttcgaacagtatttccgagacgaaagtggtctcaaccgaaaaaatattcaggataatcgggtgcattgctgcctgtatttcatcagcccgtttggccacggcctaaggcccctggacgtggagttcatgaaggctctgcaccagcgagtgaacattgtacccattcttgcaaaggctgacacccttactccacccgaggtcgatcataaaaaaaggaaaatcagagaggaaattgagcactttggtatcaagatttaccaattcccggactgcgactctgatgaagatgaggatttcaagctgcaggaccaagccctcaaagaatcaattccctttgctgtgatcggctcaaacactgtcgtggaggcaagaggcaggagagtgagggggcgcttgtacccatggggtatcgtcgaagttgagaaccccggccattgtgattttgtaaagctcagaactatgctagtgcgcactcacatgcaggatcttaaggacgtcacccgggagactcactacgagaattaccgcgcacagtgtattcagtcaatgactcggctggtggttaaggagcgcaacagaaataaactcacccgcgagtctggtactgacttccctatacctgctgttcccccagggaccgatccagagaccgaaaagctaattcgagagaaggacgaggagctgaggagaatgcaggagatgctccataagattcagaagcagatgaaggagaattat

SEQ ID NO: 32611 - DNA, 1434 bp, Artificial Sequence
  Description of Artificial Sequence: Synthetic coding sequence
atggacaggagcctgggatggcaaggtaattccgtgcctgaggataggaccgaggcaggaattaagcggttcttggaagataccaccgatgacggcgaattgtcgaagttcgtcaaggactttagtggtaatgcatcatgtcatcctccagaagcgaaaacttgggcatcaaggccacaggtgcctgagccacgcccgcaagccccagatctctatgatgatgatttggaattcagaccaccctcaagaccacaatcgtcggacaaccagcaatacttttgcgcgcctgcacccctttccccctccgccaggccacgcagcccttggggcaagctggacccgtatgattcatcggaggatgataaggaatacgtgggatttgcaacccttcctaaccaggtgcatcggaagagcgtgaagaaggggttcgactttacgctgatggtggcaggtgagagcggactcggcaaatcaaccctggtcaactcactttttctcactgatctgtatagggacagaaaacttcttggagcagaggaaagaatcatgcaaaccgttgagatcactaagcacgcagtggatatcgaagagaaaggagtgcgacttagacttaccattgtcgatacccccggattcggtgatgcggtcaataacactgaatgctggaagccagtagcagagtacatcgatcagcagttcgaacaatactttcgagatgaatctggtcttaaccgcaagaatatccaagataaccgcgtgcattgttgtctctacttcattagtccctttggacacggattgcgcccacttgatgtggaattcatgaaggccctccaccagagagtcaatatcgtgccaattctggcaaaggcggatacccttacccctcccgaagtggatcataagaagcgtaagattcgcgaggagattgaacactttggtatcaagatttaccaatttcctgactgtgatagcgacgaggatgaggactttaaacttcaagatcaagcccttaaagaatccataccattcgcagtcatcgggtccaacactgtcgtggaagcacgcggtcggagggtgagagggcgactgtacccctggggcattgtggaagtggaaaaccccggacactgcgactttgtgaaacttagaacgatgctggtgcgcactcatatgcaagatctgaaagatgtgactagagaaacccattacgagaattacagggcacaatgtatccaatcgatgactcgcctggttgtcaaggaacgaaacaggaataagctgacgagggaatctggcactgattttccgatcccagcagtccctcctggtaccgatccggaaactgagaagttgattcgggagaaggacgaagagctgcgaagaatgcaagaaatgctgcacaaaatccagaagcagatgaaggaaaactac

SEQ ID NO: 32612 - DNA, 1434 bp, Artificial Sequence
  Description of Artificial Sequence: Synthetic coding sequence
atggatcgcagcctgggatggcaggggaatagcgttccagaggacaggaccgaagccggaattaaacggtttctggaggacactacagatgatggggagctgtccaagttcgtgaaagatttctctggtaatgccagttgccacccaccggaggctaagacatgggcttcacggccccaggtgcccgagcccaggccgcaggcacctgatctgtacgacgatgacctggaattccgtccaccgagtcgcccgcagtctagtgataatcagcagtatttttgtgctcccgcccccctgtcaccttccgccagacccagatccccctggggcaaactggacccatacgattcttccgaagacgataaagagtacgttgggttcgccactctgcctaatcaggtccaccggaagtctgtgaagaaaggttttgacttcacacttatggtagctggtgaatccggcctgggcaaaagcactttagtgaattcgctcttcctgaccgacctctacagagaccggaagctcctgggagcagaggagaggattatgcagaccgtggagatcaccaagcacgcagtggacattgaggaaaagggcgtgcgcctgagactaaccatagtggatactcccgggtttggcgatgccgtcaacaacactgagtgctggaaacccgttgcggagtatattgatcagcagtttgagcaatattttagggatgagtcaggactgaaccggaagaatattcaggataatcgggtgcattgttgcttgtacttcatctcacccttcggtcatggcctgagaccactcgatgtggagtttatgaaggcgctacaccagcgagtcaatatcgtgcctatactggcaaaggccgataccctgacacccccggaggtggatcataagaagagaaagatccgggaggaaatcgaacattttggaattaagatctaccagttcccggactgcgattctgacgaggacgaagattttaagctgcaggaccaggctctgaaggaaagtatccccttcgccgtgattgggtccaacaccgtggttgaggccaggggcaggcgcgtcagagggcggttgtatccgtggggaatagtggaggtagaaaatcccgggcattgcgacttcgtgaagcttcgtaccatgctggtgagaactcatatgcaggacctcaaggatgtgactcgagagacgcattacgaaaactacagggcgcagtgtattcagagcatgaccagactggtggtaaaagagcgaaacagaaacaagttgacccgagagagcggaacggactttcctatacccgccgtcccaccaggcaccgaccctgagaccgaaaaactaatacgagagaaagacgaggagctcaggcggatgcaagagatgttgcacaaaattcagaagcagatgaaagagaactat

SEQ ID NO: 32613 - DNA, 1434 bp, Artificial Sequence
  Description of Artificial Sequence: Synthetic coding sequence
atggatagatcactcgggtggcagggaaactccgtgcccgaggatcgaactgaggccggcataaaacgatttcttgaggatacgaccgacgacggggaacttagcaaatttgtcaaagatttttccggaaatgcgtcctgtcaccccccagaggcaaaaacctgggcaagcagacctcaagtgccagaacccagaccgcaggcacctgacctgtacgatgacgatctggaatttcgcccgccttcgcgtccacaaagctcagacaaccagcaatacttttgtgcaccagcgcctctttcaccctccgctagacccagatcaccatggggaaagctggatccttacgatagctcggaagatgataaagagtacgttggatttgccaccctgccaaaccaggtgcacagaaagtctgtcaagaaaggttttgattttaccctgatggtggcaggagaaagcggtcttgggaaatcgacccttgtgaactcgctgtttctgactgatctgtacagagatcgaaagctgcttggagccgaagagcgcattatgcaaaccgtcgaaatcaccaagcatgcagtggatatcgaagagaagggtgtccgacttcgcctgacgattgtggatactcctgggtttggagatgcagtgaataacaccgaatgttggaagcctgtcgcagaatacattgaccaacagtttgaacaatacttccgtgacgaaagcggattgaaccgaaagaatatccaggacaatcgtgttcattgctgtctctactttatctcgccattcggacatggccttcgtccactcgatgtggagttcatgaaggcacttcatcaaagagtcaacatcgtccccattctggcaaaagcagataccctgactccacccgaagtggatcataagaagcggaagattcgggaggaaattgaacattttggaataaagatctaccagtttccagattgcgattcggatgaggacgaggatttcaaactgcaagatcaggctcttaaggaaagcattccatttgctgtgatcggctctaacacggtggttgaggcaagaggcagacgtgtgcgcggaaggctgtacccgtggggcattgtcgaagtcgaaaatcccgggcactgtgactttgtgaagctccgtaccatgctggtgcgcactcatatgcaagaccttaaggatgtgactcgagagactcactacgagaattaccgtgcacagtgcatccagtcgatgactagactcgtggtcaaagaacggaaccgaaacaagttgactagagagtcgggaaccgattttcccattccagcggtgccgcccgggactgaccctgaaacggaaaagctgattcgcgaaaaggatgaggaactgcgccgaatgcaagaaatgcttcataagattcaaaaacagatgaaggaaaactat

SEQ ID NO: 32614 - DNA, 1434 bp, Artificial Sequence
  Description of Artificial Sequence: Synthetic coding sequence
atggataggtcgctcggctggcagggcaacagcgtgcccgaggaccgcactgaagctgggataaaacgctttctagaggataccactgacgacggtgagctgtccaaatttgtgaaagacttcagtgggaacgcctcatgtcaccccccagaagccaaaacgtgggctagccggccccaggtgccggaaccacgcccgcaagcgccggacctgtacgatgacgaccttgaattccggccaccctcccggccccagagtagtgacaaccagcagtatttttgcgcgccagccccattaagcccatctgccaggcccagaagcccttggggcaaactggatccctacgattcttccgaagacgataaggaatacgtgggcttcgcgaccctgccaaatcaggtgcatcggaagtccgtgaagaaaggcttcgacttcacactgatggtagcaggcgaaagcgggctgggaaaatccacgctggtgaattctctgtttctgactgatctgtaccgcgatcgcaaacttctgggcgcagaagagaggattatgcaaaccgtcgaaatcacaaagcacgcggttgacattgaggaaaagggtgttcgccttcgcctcactatcgtagatactcctggatttggggacgctgtcaacaatactgagtgttggaagcccgtggccgagtatatcgatcaacagttcgaacagtactttcgcgatgagtccggactcaaccgcaaaaacatacaagacaatcgcgtccactgttgtctgtattttatttctccttttggacatggcttacgtcctctggacgtggagttcatgaaagcattacaccaaagggtgaatatagttcccatcctggccaaagcagatacactgaccccccccgaggtcgaccacaaaaagaggaagatccgggaggaaatagagcatttcggcattaaaatctatcagtttcccgattgtgatagcgatgaggatgaggacttcaaactccaggatcaggcactaaaggagtccatcccttttgccgtcataggttctaacactgtggtcgaggcacgggggcggagagtcagaggtcgcttgtacccgtgggggattgtggaggtagaaaatccggggcattgtgattttgtcaaactacgtacaatgttagtccggactcatatgcaggacttgaaagacgtgacaagagaaacccactacgagaattaccgggcccagtgtatccagagcatgacgcggcttgttgtaaaagagagaaacagaaacaagctgacccgggagagcggtaccgattttccgattccggcagttcctccgggaaccgacccagaaacagaaaagctcatcagagagaaagacgaagagcttcggcgcatgcaggagatgttgcataaaattcaaaagcagatgaaagagaattat

SEQ ID NO: 32615 - DNA, 717 bp, Artificial Sequence
  Description of Artificial Sequence: Synthetic coding sequence
atggctgcccttaaatcttggctgtcacgcagtgtcacatctttctttcggtacagacagtgcctttgtgtgccagtggtagccaatttcaaaaagaggtgcttttccgaactcattcgcccctggcacaaaaccgtgactattgggtttggcgtgaccctttgcgcagtccctatcgcccagaaaagtgagccacatagcctgtcctccgaagcgttaatgagacgggccgtaagcttggttactgattcaacgagtacattcctcagtcagacaacctacgctttgatcgaagcaatcaccgagtacactaaggctgtgtacaccctcacctctctgtatcggcagtacactagcttgctggggaagatgaatagcgaagaggaggatgaggtgtggcaggtgattatcggagcccgggcggagatgacgagtaaacaccaagaatacttgaagctagaaacaacctggatgacagctgttgggctctcggagatggcagcagaagcggcttaccagaccggcgctgatcaagcctctatcacagcacgcaatcacattcagttggtgaaactgcaggtggaggaggtacaccagctgagcaggaaggccgagacaaagctcgcggaggcccaaattgaggagctcagacagaagactcaggaagagggggaggagcgcgctgaaagtgaacaggaggcgtacctgcgagaagat

SEQ ID NO: 32616 - DNA, 717 bp, Artificial Sequence
  Description of Artificial Sequence: Synthetic coding sequence
atggccgctctcaaaagttggttatctcgctctgtgacaagtttctttagatatcggcaatgtctctgcgttcctgtagtcgccaacttcaaaaaacgctgcttctccgaacttatacggccatggcataaaactgttactatcggattcggagtgacactgtgcgcggtgcccatcgcacagaagagtgaaccacattccctttcatccgaagctctgatgaggagagctgtatcccttgttacagactctacttctacatttctgtctcagactacatacgcccttatcgaagccatcactgagtatacaaaagctgtatacacgctgacatccctatatcggcagtatacttcgctgctcggaaagatgaattccgaagaagaagatgaagtatggcaggtcatcataggagccagggctgagatgacttctaaacatcaggaatatctgaaattagaaacaacttggatgacggcagtagggttatctgaaatggcagcagaagccgcatatcagacaggagcggatcaggctagtataactgctagaaatcacatacaactggtcaagttgcaggtcgaagaagttcatcagctatcacggaaagcagaaactaaactggctgaagctcaaattgaagaactcaggcaaaaaacacaagaagagggagaagaacgagcggaatcagaacaagaagcgtatctacgggaggat

SEQ ID NO: 32617 - DNA, 717 bp, Artificial Sequence
  Description of Artificial Sequence: Synthetic coding sequence
atggcggcactcaagtcttggctgtcacgctcggtgacttccttcttccggtatagacagtgcctgtgtgtgcccgtggtggctaatttcaaaaaacgatgcttctccgaattgatcaggccgtggcacaagactgtcaccattggatttggcgtgactctttgcgcggtgcccatcgcccaaaagtcagaaccacattccctgtcatccgaggcacttatgaggcgcgcggtgagcctcgttaccgactccacgtccaccttcctctcgcaaactacctacgcactcatcgaggcaatcaccgagtacaccaaagctgtgtacactctcacttcactgtatcggcagtacacctcgctgctggggaagatgaacagcgaagaagaagatgaggtctggcaagtgatcatcggggcaagagcggagatgacctccaagcaccaggaatacctgaagctcgaaactacttggatgaccgccgtgggactttccgaaatggccgcagaggctgcctatcaaaccggagccgaccaggcctcgatcaccgcccggaaccacattcagttggtgaagctgcaggtggaagaggtccaccagctgtcccgcaaagcagagactaagctggcagaagcccagatagaagagttgcggcagaaaacccaggaggaaggagaagagagagcggaatccgagcaggaagcatacctcagagaggat

SEQ ID NO: 32618 - DNA, 717 bp, Artificial Sequence
  Description of Artificial Sequence: Synthetic coding sequence
atggccgctctcaaatcctggttgagtcggtcggtgacctctttctttcgctatcggcagtgtctgtgtgtaccggtggttgcgaatttcaagaaaagatgcttttcagaacttataagaccatggcataaaactgtgactatcggctttggggtgactctgtgtgccgtgcctattgcgcagaagagcgaacctcattctctgagctccgaggcactcatgcggagagccgtgtctctcgtgactgacagcacctctacgtttctcagccagactacgtatgcccttatcgaggcaattacagagtacactaaggcggtgtacaccctcacctccctttaccgccagtacacatctctgttaggaaaaatgaattccgaagaggaggacgaggtctggcaggtgataatcggcgcccgggccgagatgacatctaaacaccaagagtacctaaaactggaaaccacctggatgacggcggtggggctctccgagatggccgcggaggccgcataccagaccggggcagaccaggctagtatcaccgcgcgcaatcacatccagctagtgaaactgcaggttgaagaggtacatcagctgtcccggaaggctgagaccaagctcgccgaagcccagattgaggagcttaggcagaagacccaggaggaaggagaggaaagggctgagagtgagcaagaagcctatctcagagaggat

SEQ ID NO: 32619 - DNA, 717 bp, Artificial Sequence
  Description of Artificial Sequence: Synthetic coding sequence
atggcagcccttaagtcctggctgtcccgttccgtgacctcgtttttcagatacagacaatgtctttgtgtgccagtcgtggcgaactttaagaagcgatgcttctcggaactgatacgcccatggcataagaccgtgactattggttttggtgtgaccctctgtgcggtgcctatcgcacaaaagagcgaacctcattcgctgtcctcagaagccctgatgcgcagagcagtgtcacttgtcaccgatagcacgtcgacttttctgagtcaaacgacttacgcgctcatagaagccatcaccgagtatactaaggccgtgtacactctgacttcactttaccggcagtacacctcactgctcggaaagatgaactccgaagaagaagatgaagtgtggcaagtgattattggtgcacgggcagaaatgacttcaaaacatcaagaatacctgaaactcgaaactacttggatgaccgcagtggggcttagcgaaatggctgcagaagcagcataccagacgggggcagatcaagcgtcaattaccgctcggaatcatatccagctcgtgaagctccaagtggaagaagtccatcagctctcaagaaaggcagagactaagctcgcagaggcgcagatcgaggagttgcgtcagaaaacccaagaggaaggagaagagcgcgcggagtctgaacaagaggcatacctccgagaagat

SEQ ID NO: 32620 - DNA, 717 bp, Artificial Sequence
  Description of Artificial Sequence: Synthetic coding sequence
atggcagcactcaagtcctggctgagccggagcgtgaccagttttttcagataccgccaatgtctgtgcgtgccagtggttgccaactttaaaaagcgctgtttcagcgagctgatccgcccttggcataagaccgtcactattggctttggggtgactctttgtgcagtgcctattgcccagaagtcagaacctcatagccttagcagtgaggccctgatgaggcgcgccgtgagcctcgtgaccgactccactagcaccttcctttctcaaacgacctacgctctcatcgaggccattacagagtatacaaaagccgtgtacaccctcacgtccctgtacagacagtacacgagcctgctcggcaagatgaatagtgaggaagaagacgaggtatggcaggtgattatcggagcccgggccgagatgacttccaaacatcaggagtatttgaagctcgagaccacatggatgaccgcggtgggtctcagtgagatggctgccgaggcggcttatcagaccggtgctgaccaggcctccatcacagcaaggaatcacatccaactggtgaaacttcaagttgaggaggttcaccagctctcaaggaaagccgagacgaagctggcagaggctcagatagaagagctgaggcagaaaacccaagaagaaggagaagaaagagcggagtccgagcaagaggcctatctccgggaggat

SEQ ID NO: 32621 - DNA, 717 bp, Artificial Sequence
  Description of Artificial Sequence: Synthetic coding sequence
atggctgcccttaaatcatggctgtccaggtccgtgactagcttctttaggtatcgccaatgcctgtgtgtcccagtcgtcgccaacttcaagaaaaggtgcttcagcgagctgattagaccatggcacaaaacagtaaccatcggctttggagttacactttgtgccgttccaatagctcagaagtcagaacctcacagtctgtcttctgaagccctgatgcgcagggctgtatctctggtgaccgactcaaccagcacttttttgtcccagaccacttatgcactgattgaggccatcacagagtacacaaaggctgtgtacaccttgacttccctctaccgtcagtacacttccctcctcggtaagatgaattccgaggaggaggacgaagtgtggcaggtgatcattggtgcaagagccgagatgactagtaagcatcaggagtatcttaagcttgagactacttggatgaccgcagtgggtttgtctgaaatggctgcagaggccgcctaccaaaccggagctgatcaagcctcaattaccgctcgtaaccatattcagctcgtgaagctccaagtggaggaagtccaccagctgagcaggaaagcagagaccaagttggctgaggcacagatcgaggagttgagacagaaaacccaggaggaaggcgaagagagagcagagtctgagcaggaggcttatctcagggaagat

SEQ ID NO: 32622 - DNA, 717 bp, Artificial Sequence
  Description of Artificial Sequence: Synthetic coding sequence
atggccgctttgaagtcgtggctctctcggtctgtgacctctttttttcggtaccggcagtgtctttgcgtgccggtggtcgcaaacttcaaaaagcgttgctttagcgagcttattcgaccatggcacaagaccgtgactatcggctttggcgtgaccctttgcgcggtccctattgcacagaagagtgagcctcactccttgtcatcagaagctctcatgcgtcgggcagtcagcttggttacagactcaacgagtacattcctgagccagacaacatatgccctaatcgaggcgattacagagtatacaaaggccgtgtacaccctaaccagtctctaccggcagtatacttcgctgctggggaaaatgaattcagaggaagaagatgaagtttggcaggtaattattggagctcgcgccgaaatgacgtccaaacatcaggagtaccttaagttagagacaacctggatgactgcagtcggcctgtcagaaatggccgccgaggctgcttaccagaccggcgctgatcaggctagcataacagcgcggaaccacatccagctcgttaagttacaggtggaagaggtccaccagctcagcaggaaagctgagaccaaactggctgaggcccaaattgaagaacttcggcagaaaacacaggaagagggtgaggaacgggcagagtccgaacaggaagcatacctgcgcgaggat

SEQ ID NO: 32623 - DNA, 717 bp, Artificial Sequence
  Description of Artificial Sequence: Synthetic coding sequence
atggccgctctcaaatcctggctgtcgcgctcagtgacttcgtttttcagatacagacagtgcctgtgcgtgccggtcgtggcgaacttcaaaaagcgctgcttcagcgaattgataagaccatggcacaaaaccgtcaccatcggattcggagtgacgctctgcgccgttccgattgcccaaaagagcgagcctcatagcttgtcctcggaggctctgatgaggagagctgtgtccctcgtgactgattctaccagcaccttcttgtcgcaaaccacctacgccctgattgaagccatcacggaatacactaaggccgtgtacactctgacctccctgtaccggcagtacacttccctcctgggaaaaatgaactcagaagaggaagatgaagtgtggcaggtgattattggggcccgcgccgaaatgacgtccaaacatcaggagtacctgaagttggaaaccacttggatgactgcggtcggactgagcgagatggccgctgaggccgcgtaccaaaccggcgcagaccaggcatccatcaccgcacggaaccacatccaactggtcaaactgcaggtggaggaggtgcatcaactcagccgcaaggccgagactaaactcgcggaggcccagatcgaagagctccggcaaaaaactcaggaagaaggcgaagaaagggcagagtcggaacaggaagcctacctgagggaagat

SEQ ID NO: 32624 - DNA, 717 bp, Artificial Sequence
  Description of Artificial Sequence: Synthetic coding sequence
atggccgctttgaagagctggcttagcaggtccgtgacttcattcttccgatataggcagtgtctatgcgttcccgtagtggctaacttcaagaaacggtgcttcagtgaactcatcagaccatggcacaagacagtgacaataggttttggagtcaccctctgcgccgtccccattgcccagaagtccgagccgcacagcctgtctagtgaggccctgatgagacgtgcggtgtcactcgtgacagattctacctcgacatttctgtctcagaccacatacgcgctcatcgaagccattaccgagtataccaaagccgtatacactctcaccagtctgtatcggcaatatacttccctcctcggcaaaatgaactccgaggaggaggacgaggtgtggcaggtaatcatcggggctagggccgagatgacttcaaagcaccaggagtacctgaaactagaaactacgtggatgactgctgtgggcctatctgagatggcagcagaggccgcatatcagactggggcagaccaggcctccatcacggcaagaaaccatatccagctggtgaagttgcaggtggaggaggttcaccagctgtcaagaaaggcggagacaaaactagccgaggctcagattgaagagctgcgccagaagacacaagaggagggcgaggagcgcgcagagagcgagcaggaggcatatctgcgagaggat

SEQ ID NO: 32625 - DNA, 717 bp, Artificial Sequence
  Description of Artificial Sequence: Synthetic coding sequence
atggcagccctgaaaagctggctgtcccgaagcgttacgtctttttttcgctatcgtcaatgtctgtgtgtgccagtagtggctaactttaaaaagcgctgcttctcagagctgatccgcccgtggcacaaaaccgtcaccataggctttggtgtcaccctctgtgctgtccctatcgcgcagaagtctgagccccactcactctctagcgaggcactgatgagacgtgcggtgagcctggtgacggattctactagcacctttctgtcccaaaccacctacgccttgatcgaagccatcaccgaatatacgaaggcagtgtatacactgacgagcttgtacaggcagtacaccagcctgctcgggaaaatgaatagcgaggaagaggacgaggtctggcaagtcataataggcgcccgtgccgagatgacaagcaagcaccaggagtacctgaaactggagaccacgtggatgaccgcggtgggcctcagcgagatggctgcggaagctgcttatcagacaggcgctgatcaggcgagcatcaccgcgcgcaaccatatccaactggtgaaactgcaggtggaagaagtgcaccagctttcaaggaaagccgaaaccaaactggctgaggcccaaattgaagaactccgccagaaaactcaagaggaaggtgaggagcgggcagagagcgagcaggaagcctatttgcgggaagac

SEQ ID NO: 32626 - DNA, 717 bp, Artificial Sequence
  Description of Artificial Sequence: Synthetic coding sequence
atggcggccctgaaatcatggctcagccgtagcgtcacgtccttcttcagatacaggcagtgcctgtgcgtcccagtggtggcgaactttaagaagcgctgctttagcgaacttatcaggccgtggcataaaactgtgactattggatttggggtgacgctgtgcgccgtcccgatcgctcagaagtccgaaccacattcactgtcatcggaggcccttatgcggcgggcggtgtcgcttgttacggactccacttccaccttcctgtcacaaaccacctacgcactcatcgaggctattaccgaatacactaaggcagtgtacaccttgaccagcttgtaccggcagtacactagcctgctgggcaagatgaattccgaggaagaggatgaagtctggcaagtcatcatcggagcacgggccgagatgacttcgaaacaccaggagtacttgaaactggaaaccacgtggatgactgcagtcggactgtccgagatggccgcagaagccgcataccaaaccggagccgaccaggcctccatcaccgcccgaaaccatattcaattggtgaaactgcaggtggaggaagtgcaccagctctcgagaaaggcggagactaaacttgcagaggcccagatcgaagaactgcggcaaaagacgcaagaggaaggtgaagaaagggctgagtctgagcaggaggcctatctcagagaagat

SEQ ID NO: 32627 - DNA, 717 bp, Artificial Sequence
  Description of Artificial Sequence: Synthetic coding sequence
atggcagccctcaagagttggttgagccggtccgtgacatcctttttcaggtataggcagtgcctttgcgtacctgtggtggcgaacttcaagaagcgttgtttctctgaactgatcaggccttggcacaaaacggtgaccatcggtttcggagttaccctatgcgctgtacccatcgctcaaaagtccgagcctcattccctgtcttcagaagctcttatgagaagagctgtttcgctcgtgaccgatagtacctctacctttctttcccagacaacatatgcactaatcgaggctattacagaatacaccaaggccgtttatactctcacaagtctctacaggcagtatacctcgctcctgggtaaaatgaattctgaagaggaagacgaagtctggcaagtgattattggcgcccgggccgaaatgacaagcaaacatcaggaatatctgaagctggaaaccacttggatgaccgccgttgggcttagcgagatggcggccgaagctgcatatcaaaccggagccgatcaggcgagcataacagcgcgcaaccacattcaactggtgaagctccaggtggaggaggtccaccagctgagcaggaaggctgaaacaaagctagcagaagcacaaatagaggagttacgacagaagacacaagaagaaggagaggagagggccgagtccgaacaggaggcctacctgagggaagac

SEQ ID NO: 32628 - DNA, 717 bp, Artificial Sequence
  Description of Artificial Sequence: Synthetic coding sequence
atggcagcgctgaagagctggctctcaagatcggtgactagcttcttccgctacaggcaatgcctgtgcgtcccggtcgtggccaacttcaaaaagcggtgcttttcggagctgattcgcccttggcacaaaaccgtcaccatcggatttggagtgaccctgtgcgccgtgcccatcgcccagaaatcggaaccgcacagcctctcgagcgaggctcttatgagaagagcagtgtcgctggtgaccgactccactagcaccttcctgtcgcagaccacctacgcgctcattgaagccatcaccgaatacactaaagcagtgtataccctcaccagcctgtaccggcagtacacttcgctcctgggaaaaatgaattccgaggaagaggacgaagtatggcaagttatcattggcgcccgcgccgaaatgacctcaaagcaccaggaatacctcaaactcgagactacgtggatgactgcagtgggcctgagcgagatggctgccgaagccgcctaccagaccggggcagatcaggcgagcatcacggcccgaaatcacattcaacttgtgaagctgcaagtcgaagaagtccatcagttgtcaaggaaggccgagactaagttggccgaggcccagatcgaggaactgcgccaaaagactcaggaggagggagaggaacgggccgagagcgaacaggaggcttacctccgggaggac

SEQ ID NO: 32629 - DNA, 717 bp, Artificial Sequence
  Description of Artificial Sequence: Synthetic coding sequence
atggctgcattgaaatcatggctgtcacggtccgtgacttccttttttcgctacagacaatgtctgtgtgttcctgtcgtcgcaaacttcaaaaagcgatgtttttccgaactgattaggccatggcataagactgtgaccatcggctttggagtcactctgtgtgcggttccaatcgcccaaaagagcgagccgcactccctttcgtcagaggccctcatgagacgagccgtgtccctggtcactgattccactagcaccttcctgtcccagaccacctacgcacttatcgaagccatcaccgaatataccaaggcggtctataccctgacctccctttaccgccaatacacgagccttctcggaaaaatgaattcggaagaagaagatgaggtctggcaagtgattatcggcgcccgagctgaaatgactagcaagcatcaggaatacctcaagctcgaaaccacttggatgaccgcagtgggcctgagtgaaatggcagcagaagcagcttatcagactggagccgaccaggcgtcaattactgctcggaatcacatccagctggtgaaactccaagtcgaagaagtgcaccagctgagccgcaaggcggaaaccaagctggcagaggcacaaattgaggagcttagacaaaagacgcaggaagagggagaggaacgcgcagagtcggaacaagaagcatacctgcgggaggac

SEQ ID NO: 32630 - DNA, 717 bp, Artificial Sequence
  Description of Artificial Sequence: Synthetic coding sequence
atggcggctctgaagtcttggctctctaggtcagtgactagtttcttccgctatcgccagtgtctgtgcgtgccagtggtggcaaacttcaagaaaaggtgtttttccgagcttatccgcccatggcataagaccgtcacaatcggttttggcgttactctctgtgctgtgccaattgcacaaaaatcagaaccacacagcctgagctctgaggccctgatgaggagggccgtctctttggtcacggattctacctccactttcctgagtcagaccacatatgctcttatcgaggccatcaccgagtatactaaagccgtctacacgctgacctctctgtacagacagtatacctcactgctgggaaagatgaatagcgaggaggaggatgaggtctggcaagtgatcatcggagccagagccgaaatgacctctaaacatcaagagtacttgaaattggaaacaacatggatgaccgcggtaggactgtctgagatggcggccgaagctgcctatcagaccggcgcggaccaggccagcattaccgcaaggaaccatattcagctcgttaagctccaagtggaggaagtgcatcaactgtccagaaaggcggaaacgaaacttgcggaagcacagattgaggaacttcgccaaaagacgcaggaggagggagaagagagggccgagagcgaacaggaagcttacttgagagaggat

SEQ ID NO: 32631 - DNA, 717 bp, Artificial Sequence
  Description of Artificial Sequence: Synthetic coding sequence
atggccgcacttaaatcgtggctgtccaggtcagtgacctccttctttagataccgacaatgcctttgtgtgccggtggtcgcaaactttaagaaacgctgtttctcggagttgataagaccttggcataagaccgtgactataggcttcggagtcaccctttgtgcagtgcctattgcacagaagtcagagcctcactcgctctcgagcgaggccctcatgcggagagccgtgtcgcttgtcactgactcgacctcaaccttcttgtcccaaactacctatgccctcattgaagcaatcactgaatacactaaggcagtgtataccctcactagcctctaccggcaatacactagcttgcttgggaaaatgaactctgaggaagaagatgaagtgtggcaggtgatcattggggcacgcgcagaaatgacgagcaagcatcaggaatacctcaagctcgaaacgacctggatgaccgcagtgggactgagcgaaatggcggcagaagccgcataccagaccggggctgatcaagcatcaatcacggcacgtaaccatattcaactggtcaaacttcaagtggaagaggtgcatcaactttcgcggaaggctgaaaccaagctggccgaagctcaaatcgaagagctccgccaaaagactcaggaagaaggggaagaaagagcagaatccgagcaagaagcgtacctgagagaggac

SEQ ID NO: 32632 - DNA, 717 bp, Artificial Sequence
  Description of Artificial Sequence: Synthetic coding sequence
atggcagcacttaagtcttggctctccagaagtgttacaagtttcttccgctatcggcagtgtctttgcgtgcctgtggtggctaatttcaaaaaacggtgcttctctgaactgatccgaccatggcacaagacagtcacgattggcttcggcgtgacactgtgtgccgtgccgattgcccagaaaagtgagccacacagtctatcctcagaagccctgatgcgacgagccgtttcactcgtgacggattcgacgtcaaccttcctttcacagacaacctatgcactgattgaggcaattaccgaatacacaaaggctgtgtacactcttacctccctctatcggcaatacaccagtctgttgggcaaaatgaattcagaggaagaggacgaagtttggcaggtcatcattggcgctcgggcagaaatgacaagcaagcaccaggagtacctgaaactggaaaccacctggatgacggccgttggacttagtgaaatggccgctgaggctgcttaccagaccggcgccgaccaggcgagcatcaccgccagaaaccacattcagctggtgaaactccaggtggaggaggtccaccaactctccagaaaggcagaaaccaagcttgctgaggcccagatcgaagagctgagacagaagacgcaagaggaaggcgaagaacgggcagagtccgagcaggaggcttatctacgcgaagat

SEQ ID NO: 32633 - DNA, 717 bp, Artificial Sequence
  Description of Artificial Sequence: Synthetic coding sequence
atggccgccctgaagagctggcttagcagaagtgtgacttctttcttcaggtaccgccagtgtctttgcgtccccgtggtcgccaactttaagaaaaggtgcttctccgaacttataagaccgtggcacaagacagttacaatcggttttggcgttaccctctgtgctgtccctatcgctcaaaaatccgaaccacacagcctcagctctgaggccttgatgagaagggctgtctctctagttactgatagcaccagcactttcctgtctcaaacaacctacgccctgatcgaagcaattaccgagtataccaaagcggtgtacacgctcaccagcctgtataggcaatacactagcctattgggcaagatgaattctgaggaagaagacgaggtgtggcaggtcattatcggcgcaagggccgagatgacgagtaagcaccaagaatacttgaagttggagaccacatggatgaccgcagtgggcctcagcgaaatggctgctgaggccgcataccaaaccggcgcagaccaagcctcgatcaccgctcggaaccatatacagttggtcaagctgcaggtcgaggaggtgcaccagctgtcaagaaaggccgaaaccaagctcgctgaagctcagattgaagagctgaggcagaagactcaagaagagggcgaagagagggctgaatccgagcaagaggcctatctgagagaggat

SEQ ID NO: 32634 - DNA, 717 bp, Artificial Sequence
  Description of Artificial Sequence: Synthetic coding sequence
atggcagccctcaaaagctggctgtccagatcagtgacttcgttcttccgctaccgccagtgcctgtgcgtcccggtggtggcgaactttaagaagaggtgctttagcgagctgatcagaccgtggcacaagaccgtcacgatcggattcggagtgaccctgtgcgccgtgcccatcgcacagaaaagcgagccgcacagtctttcctccgaggcgctgatgcggagggctgtgagcttggtcacggactcaacctcgactttcttgtcacaaactacctacgcgctgatcgaggcaattaccgaatacactaaggctgtgtacaccctgactagcctgtacagacagtacacctccctcctggggaagatgaactccgaagaggaggacgaagtatggcaagtcatcatcggagctagagcagaaatgacttcaaaacatcaggagtacttgaaacttgagactacctggatgaccgcggtgggactgtcagaaatggctgccgaggcggcctatcagaccggcgccgaccaagcctcgattacggcacgcaaccatatccagctcgtcaagctccaggtggaagaggtgcaccagttgtcccgcaaggccgaaaccaagctggctgaagcccaaatcgaagaactgcggcaaaaaactcaggaggagggcgaagagcgggccgagtcagagcaggaagcctacctgcgggaagat

SEQ ID NO: 32635 - DNA, 717 bp, Artificial Sequence
  Description of Artificial Sequence: Synthetic coding sequence
atggccgcactgaaatcctggcttagtcgatccgtgacgtccttctttagatatcgccaatgcctatgtgtgccagttgtggccaacttcaagaaaaggtgcttcagcgaactgatcagaccgtggcacaagacagtaaccattggattcggggtcaccctgtgtgcagtgccgatcgcgcagaaatcagagccacattcactgtcatcagaggcccttatgcgaagggccgtgtcgctggtgacagattccacgtctacatttttatcgcagactacctacgcccttatcgaagccatcactgaatacaccaaagctgtgtatactctcacctctctctaccggcagtatacctcacttctgggaaaaatgaattctgaggaggaggatgaggtatggcaagtgatcatcggcgcacgtgctgagatgactagcaaacatcaggagtacctcaaactggaaactacgtggatgaccgctgtcggtctgagcgagatggccgccgaagccgcttaccagaccggggctgaccaggcatcaattaccgcccgaaatcacatccagctggtcaagctgcaagttgaggaggtccaccagctctcacggaaggccgagacaaaactcgctgaggcacagatagaagaattaagacagaagacccaggaagagggcgaggaacgggctgagtctgagcaggaggcatacctcagggaggat

SEQ ID NO: 32636 - DNA, 717 bp, Artificial Sequence
  Description of Artificial Sequence: Synthetic coding sequence
atggccgcattgaagtcctggttgtcccgctcggtgacttcgtttttccggtaccggcagtgtctctgcgtccccgtggtcgctaacttcaagaagaggtgcttttctgagctgatccggccgtggcacaagactgtcacgattggtttcggggtgactctgtgcgcggtgcctatcgcgcagaagtcggaaccgcacagcctgagctcagaagcccttatgaggagggctgtctcgctcgttactgacagcacctccacttttctctctcaaactacctacgcactgatcgaagctatcactgagtacactaaggcggtgtacaccctcacctccttgtacagacaatatacctccctgctgggaaagatgaattcggaagaagaggatgaagtgtggcaggtgatcattggagcccgggctgaaatgacgtcgaaacatcaggaatatctcaaactcgaaaccacctggatgaccgccgtcggactttccgagatggccgccgaagcagcgtaccagaccggagctgaccaggcgagcataaccgcgcgcaaccatattcagctggtgaagctgcaagtggaggaggtgcaccagctgtctcgtaaagcggaaactaagctggccgaagcacaaatcgaggagctgagacagaaaactcaagaagagggcgaggaacgcgccgaatcggaacaggaggcatatctgcgagaagat

SEQ ID NO: 32637 - DNA, 717 bp, Artificial Sequence
  Description of Artificial Sequence: Synthetic coding sequence
atggccgctctcaagtcctggttgtcccgctccgtaacatcatttttccgatatcgtcagtgtctgtgtgttccggtggtcgccaattttaagaaacgttgtttcagcgaactcatccgaccgtggcacaaaacagtgacaattggcttcggggtcactctgtgtgcagtaccgatagcacagaagagcgagccacactctttatcctctgaggccctaatgcgtcgagctgtgagcctggtcaccgattctacttcgacattccttagtcaaaccacctatgctctcatagaggctatcaccgagtatactaaggcagtttacaccttaaccagtttgtatcgccagtacacttctctcctgggtaagatgaacagcgaggaagaggacgaggtttggcaggtgatcatcggagcgcgggcagaaatgacgtcgaaacatcaggagtacttaaaacttgagacgacctggatgactgcagtgggactttcggaaatggccgccgaggcagcgtatcaaaccggtgccgaccaagcaagtatcacagcgcggaaccatattcaacttgtcaaattacaagtagaagaagtacaccaattatcacgcaaggctgagactaagctcgccgaagcgcagatcgaggagttaagacagaagacccaggaagaaggcgaggagcgtgcggagtccgaacaagaggcgtacctgcgggaggac

SEQ ID NO: 32638 - DNA, 717 bp, Artificial Sequence
  Description of Artificial Sequence: Synthetic coding sequence
atggcagcactcaaatcgtggctgtcgcgtagcgtcacttcgttctttagatacaggcagtgtctttgtgtgcccgtcgtcgcaaatttcaagaagagatgcttttcagagctcattcggccatggcataaaactgtcactatcggatttggcgtcaccctgtgcgccgtccctattgcacaaaagtcggagccacattcgttgtcatccgaagcactcatgagaagagcggtttccctggtgaccgactccaccagcacctttctgtctcagactacttacgctttgatcgaagcaattaccgaatacactaaggcagtgtacaccctcacttccctgtaccgtcaatacacgtcgctgctcggtaagatgaattcggaagaagaagatgaggtgtggcaggtgattatcggtgcccgcgcagaaatgacttcgaagcatcaagaataccttaagttggaaacgacttggatgaccgcagtgggcctttccgaaatggcagcagaagcagcataccaaaccggggccgatcaggcatcgatcactgcacggaaccacatacaactggtgaagctccaggtcgaggaggtgcaccaactctcgcggaaggctgagactaagctggcggaagcacagattgaagagcttagacaaaagacgcaagaagagggggaagaaagagcagagtcggaacaagaggcctacttgagagaagat

SEQ ID NO: 32639 - DNA, 717 bp, Artificial Sequence
  Description of Artificial Sequence: Synthetic coding sequence
atggcggcccttaagtcttggctatcccggagcgtgaccagcttttttcgctatcggcagtgtttgtgtgttcctgtcgtggccaattttaagaagcggtgcttctcggagcttattagaccatggcacaaaacagtgaccattggctttggtgtgaccctgtgcgccgtcccaattgcgcagaagagcgaacctcattcactgagttccgaggccctcatgaggcgcgccgtcagccttgtgacggatagcacatcgactttcctgtcccagacaacatacgccctgatcgaagccatcaccgagtacactaaggcagtctacaccctgaccagtttgtatagacagtatacaagtctgctaggaaagatgaatagtgaagaagaagacgaagtgtggcaggtgatcattggtgccagagcagaaatgacatcgaagcatcaggagtacctgaagttggaaactacctggatgacagcggttggactgtccgagatggctgctgaggcggcttaccagacaggcgctgatcaggcctccatcaccgctcgtaatcatatacagctggtgaagttacaagtggaagaggttcaccagctgagcagaaaagctgagactaagcttgctgaagctcagatagaagagttgagacagaaaacccaggaagaaggtgaagaaagggcggaaagcgagcaggaagcttatctgcgggaggac

SEQ ID NO: 32640 - DNA, 717 bp, Artificial Sequence
  Description of Artificial Sequence: Synthetic coding sequence
atggccgccctgaaatcctggctgagccgctctgtgacatcttttttccggtataggcagtgcctgtgcgtgccggtcgtggccaattttaagaaacgctgcttcagcgagctgattagaccctggcacaagaccgtcacaatagggttcggtgtaaccctgtgcgctgtccctattgcacaaaagagcgagccccatagcctgagctccgaggcgttaatgaggcgggccgtgtcattggtgacggactccacctccacatttctgtcacagacaacttatgcattgattgaggctatcacagagtatacaaaggcagtctatacactgacctccctctatagacagtacacctccctgctcggcaagatgaattccgaggaagaagatgaggtgtggcaagtgatcataggagccagagcagagatgacgtcgaagcaccaggaatacctgaaactggagaccacttggatgacagccgtcggactcagcgagatggcagccgaagcagcgtatcaaaccggcgccgatcaggcaagtataacagcaagaaatcatatccagctggtgaagctgcaagtagaggaagtccaccagctgagccgcaaggccgagaccaagctcgccgaagcccaaatcgaggagcttcgacagaagactcaggaagaaggggaggaaagggcagagagtgagcaagaggcctatctgcgtgaggac

SEQ ID NO: 32641 - DNA, 717 bp, Artificial Sequence
  Description of Artificial Sequence: Synthetic coding sequence
atggccgccctgaagtcctggctgtcgcggtcagttacgtcgttttttcgctaccgtcagtgcctctgcgtccctgtggtggccaatttcaaaaaacgatgcttctcagaactgatcaggccgtggcataagactgttacgatcggatttggagtgacgctgtgcgccgtcccaatcgcgcagaaaagcgaaccacactctctcagcagtgaagcgctgatgcggcgggcagttagcctggtgactgattcgacttcgaccttcttgagccagactacttacgcgttgatcgaggcaatcactgagtataccaaggccgtgtacactctgacctccctgtacaggcagtacaccagcctcctcggaaagatgaactccgaagaagaagatgaggtgtggcaggtcatcattggagcccgcgcagaaatgacttccaagcatcaagaatacctcaagctggaaaccacctggatgactgcggtgggcctctcggagatggcagcagaagccgcctaccagactggagcagaccaagcatccatcactgccagaaaccatatccagcttgtgaagttgcaggtcgaggaagtgcaccagctcagccggaaggcggagacgaagctggccgaggcccaaatcgaagagcttcgacagaaaacccaagaagaaggcgaagagagggccgagtctgagcaggaggcctacctgcgcgaggac

SEQ ID NO: 32642 - DNA, 717 bp, Artificial Sequence
  Description of Artificial Sequence: Synthetic coding sequence
atggctgcattgaagtcatggttatctcgaagtgtgactagttttttcagatatagacaatgtctttgtgttccagttgttgctaattttaaaaaaagatgtttttcagaacttattagaccatggcataaaacggtaacgattggatttggagttacattatgtgctgttccaattgctcaaaagtctgaacctcactctttatcctcagaagctcttatgaggagagcagtatcgttggttacagattcaacatcaacgtttttgtcacaaaccacttatgcattaattgaagcaattacagagtatactaaagctgtttatactttaacatcattatatagacaatatacctctttattaggaaaaatgaatagtgaagaagaagatgaagtatggcaagttattattggtgcaagagctgaaatgacttcaaaacatcaagaataccttaaactagaaacaacttggatgacagctgtcggacttagtgagatggcagcagaagcagcatatcaaacaggagctgatcaagcatcaatcactgctagaaatcacattcaattggtcaaattacaagtagaagaggtacatcaattgtctagaaaggcagaaacaaaactcgctgaagcacaaattgaagaattgagacaaaagacacaagaagagggtgaagaaagagcagaatctgaacaagaagcttatttaagagaagat

SEQ ID NO: 32643 - DNA, 717 bp, Artificial Sequence
  Description of Artificial Sequence: Synthetic coding sequence
atggcggccctgaaaagctggctcagcagaagcgtgacaagcttctttaggtatcgtcagtgcctctgtgtcccggtcgtggcaaatttcaagaagcgatgtttctcagagctcattagaccctggcataaaaccgtaaccatcggcttcggggtgaccctctgtgctgtccctatcgcccaaaaatccgaaccacattcgttgtcatccgaggccctcatgcgccgcgccgtttccctggtgactgattccacttcgacctttctctctcagacaacatatgcactgatcgaagctatcaccgaatacaccaaggctgtctatacgctgacatccctgtaccgccaatatactagcctattgggtaaaatgaatagcgaagaggaggatgaagtgtggcaggtgatcatcggagccagagcagagatgacatctaagcaccaggaatatcttaaactcgaaactacatggatgactgccgtaggactgtccgaaatggcggccgaggccgcctatcaaacaggtgcggaccaggctagcattaccgcgcggaatcacatccagttagttaagcttcaagtggaggaggtacatcagctgtccagaaaggcggagacaaagctcgcagaggcgcagatagaagagttacggcaaaagacgcaggaagaaggcgaggaaagggctgagtctgagcaagaagcctacctccgagaagac

SEQ ID NO: 32644 - DNA, 717 bp, Artificial Sequence
  Description of Artificial Sequence: Synthetic coding sequence
atggccgccctgaagtcatggttgtctcggagcgtcacttcattcttccggtacagacagtgcctctgcgtgcccgtcgtggcgaacttcaaaaagagatgcttctcagaactgatccggccttggcataaaaccgtgacgatcgggttcggcgtcactttgtgcgcagtgccaatcgcgcagaagtcagaaccacactccctgtcgagcgaagcgctcatgcggagggcagtgagcctggtgactgacagcacttcgacgtttctgagccagactacttacgccctgatcgaagcgataactgagtacacgaaagccgtgtatactctcacttcgctgtacaggcaatacacctccctgttgggtaagatgaattcggaggaggaagatgaagtctggcaggttatcattggcgccagagcggaaatgacctctaagcaccaagagtacctcaaactggaaaccacctggatgaccgccgtggggctgtcagaaatggcagcagaagcagcctaccaaactggagcagaccaagcgtcaatcaccgcccgcaaccatatccaacttgttaagctgcaggtggaggaagtgcaccaactgtcacgcaaggcggagactaagctcgcggaagcccagattgaagaactccgccagaaaacgcaagaggagggcgaggagagggcagagtcagaacaggaggcgtacctccgcgaagat

SEQ ID NO: 32645 - DNA, 717 bp, Artificial Sequence
  Description of Artificial Sequence: Synthetic coding sequence
atggccgcactcaagagctggctgtctcggagtgttacctcttttttcaggtatcgacagtgtttatgcgtccccgtggtggccaacttcaagaagagatgtttttcagagctgattcgaccctggcataagacagtcacaataggctttggcgtgaccctctgtgccgttcctatcgcacaaaaatcagagccccatagccttagttcagaagcgctgatgaggcgcgcggtttccctggtgacagactcgacatccacgttcctgtcccagaccacgtacgcactgatagaggcaatcactgagtacacaaaggccgtatacacactgacgagcctctatcggcagtatacaagcttgctggggaagatgaacagcgaggaagaggacgaagtgtggcaggtgatcatcggggcccgggcggaaatgacaagcaagcaccaggaatacctgaagctggagactacgtggatgactgctgtcggactgagcgaaatggcagcagaggccgcttaccagactggcgccgaccaggcatctataacagcgagaaaccatattcagctggtgaaactacaggtggaggaggtgcaccagctgtctcggaaggccgaaactaaactggccgaggcccagatcgaagaacttagacagaagactcaggaggagggagaggagcgtgcagagtccgaacaagaagcttatctgcgggaggac

SEQ ID NO: 32646 - DNA, 717 bp, Artificial Sequence
  Description of Artificial Sequence: Synthetic coding sequence
atggctgctctcaagtcgtggctttcccgcagcgtgacctcattctttcggtacagacagtgcctgtgcgtccctgtcgtcgcaaatttcaagaaacgctgcttctcggaactgattagaccgtggcacaagaccgtgaccatcggatttggtgtcactctgtgtgccgtgccgatcgcccaaaagagcgaaccacactccctcagctcggaagctctgatgcgccgcgctgtgtcgttggtcactgactccacttcaacgttccttagccaaactacctacgcgctgatcgaggcaattactgagtataccaaggccgtgtacaccctcacttcactgtaccgacaatacacttcgttgctcgggaagatgaactccgaagaggaggatgaggtgtggcaggtgatcatcggagcccgtgcggagatgacctctaaacatcaggaatacctgaagctggagacgacttggatgacggccgtgggcttgtcagaaatggccgccgaggccgcgtaccaaaccggcgcagatcaggcgtcgatcaccgcacggaaccatatccagctcgtgaaactgcaggtggaggaagttcaccaactcagccggaaggcggaaaccaagctggcagaagcgcagatcgaggaactgcggcaaaaaactcaggaagaaggagaagagagagccgaatccgaacaggaggcctacctgagggaggac

SEQ ID NO: 32647 - DNA, 717 bp, Artificial Sequence
  Description of Artificial Sequence: Synthetic coding sequence
atggctgctttgaaatcttggctatccaggtctgtaacttcattcttcaggtatcgacagtgtttgtgtgtgcctgtcgtcgctaattttaagaaaagatgcttttcagagctcatccgaccctggcataaaacagttacaatagggttcggggttacactttgcgcagtgcctatcgcccagaagagtgagccacactcactctcgagtgaagcgttgatgaggagggccgtctctttggtaactgactccacatccacatttctgtcacagactacttatgccttaatcgaagccattactgaatatactaaagcagtttatacacttacatccctatatcggcagtacacttctctactcgggaaaatgaactcagaggaagaagatgaagtgtggcaggtcataatcggggcccgggccgaaatgacttccaaacatcaggaatacttgaaactagaaactacttggatgacagccgttgggttatcagaaatggccgcagaagccgcctatcagacaggagccgatcaggctagtatcactgcccgaaatcacatacagctcgtaaaactccaagtggaagaagtccaccaattgtcaaggaaagcggaaactaaattagccgaagctcagatagaagagctgcggcagaaaacacaggaagaaggagaagaacgcgctgaaagtgagcaggaggcctacttaagagaagat

SEQ ID NO: 32648 - DNA, 717 bp, Artificial Sequence
  Description of Artificial Sequence: Synthetic coding sequence
atggcggccctgaaaagctggctgtcccgttccgtgacgtcgttttttcgataccggcaatgcttgtgtgtgcctgttgtggcaaacttcaaaaagagatgtttttcagagcttattagaccctggcataagactgtgaccattggcttcggagtgactttgtgtgccgtgccgatcgcacagaagtccgaaccgcactcgctttcgagcgaagcacttatgagacgcgccgtctccctcgtgactgattctacctcaacgttcctttcgcaaaccacttacgcacttatcgaagctatcactgaatacaccaaggccgtgtacactctcacttcgctctacaggcaatacacctccttgcttgggaagatgaactcagaggaggaggatgaggtgtggcaagtgataattggagctcgcgcagagatgacttcaaaacaccaagaatacctgaaactggaaaccacgtggatgactgcagtgggtctgtccgaaatggcagcagaagcagcgtaccagaccggcgcagaccaagcgtcgattactgcccggaatcacattcagcttgtgaagttgcaagtcgaggaggttcatcaactctcaagaaaagcagaaactaagctggcagaagcacaaattgaagagttgagacaaaagactcaagaggaaggagaagaaagagcagagagcgagcaagaagcatacctccgtgaggat

SEQ ID NO: 32649 - DNA, 717 bp, Artificial Sequence
  Description of Artificial Sequence: Synthetic coding sequence
atggccgcactcaagagctggctgtcccgaagcgttacctccttctttcgctacaggcagtgcctgtgcgtcccagtggtggctaacttcaaaaaacggtgcttctccgaactgattagaccctggcataagaccgtcaccatcggctttggagtgaccttgtgtgcagtcccaatagcccaaaagtcggagccgcactcactttcgagtgaagctctcatgcgccgcgccgtgtccctcgttactgactcgacttctaccttcctcagccaaactacttatgccctgattgaagccatcactgagtacaccaaggccgtctacactctgacttcgctgtacagacagtacacttcactgctcggcaagatgaattccgaagaagaagatgaagtgtggcaggtgatcatcggtgcccgcgcagaaatgacctcgaagcaccaagaatacctgaagctggaaaccacctggatgacggcggtgggactcagcgaaatggcggccgaagcggcgtaccagacgggagccgatcaggccagcatcaccgcccggaaccacatccaactggtgaaattgcaggtggaggaggtgcatcagcttagccggaaggctgagacgaagttggcggaagcccagatcgaagaactgcggcagaaaacccaagaagaaggagaggaacgggctgagtcggagcaggaggcctacctgagagaagat

SEQ ID NO: 32650 - DNA, 717 bp, Artificial Sequence
  Description of Artificial Sequence: Synthetic coding sequence
atggcagccttgaaaagctggctttccagatcagtgaccagcttttttcgctacaggcagtgtctttgcgtccccgtggtggccaatttcaagaagcgctgtttctcagagttgattagaccgtggcataaaactgtgaccataggatttggggtgactctttgtgcagtgccaattgcccaaaagtcggaaccccatagtctgtcctcggaggctttgatgaggagagcagtctctcttgtgaccgatagcacttccacctttctttcccagaccacgtatgccctgattgaagcgataactgaatacactaaggccgtctacacccttacttcattgtacagacagtacacctcacttctcgggaagatgaactccgaggaggaagatgaagtgtggcaagtgatcattggagcacgcgcggagatgacttcaaagcatcaagagtacctcaaactggagactacctggatgaccgcggtgggattgtccgaaatggctgcagaggcagcataccagaccggtgcagaccaggcatcgatcacggctcgaaaccatatccaacttgtgaagctccaagtggaagaggtgcatcaactctcgcggaaggccgaaaccaagctggcagaagcacaaatcgaagaactgagacaaaaaacccaagaagaaggtgaggaacgtgcggagtccgagcaagaggcgtacttgagagaagat

SEQ ID NO: 32651 - DNA, 717 bp, Artificial Sequence
  Description of Artificial Sequence: Synthetic coding sequence
atggccgccctgaagtcctggctttctcgctctgtcacaagttttttcagataccgccagtgtctgtgtgtgccagtcgtggcgaacttcaagaagcggtgcttctccgagctgattagaccgtggcataagacggtgacgatcggctttggtgtgactctgtgcgctgtgcccatcgctcagaagtccgagccccacagcttgagctctgaggccctcatgcgtagagccgtgtccctcgtgacagactccacctcaaccttcctgtcccagactacttacgcgctaatcgaagccattacggaatacactaaagccgtttatacgctgactagtctgtacagacagtatacctcattgctcggaaagatgaacagtgaggaggaagatgaagtgtggcaggtcatcattggcgctagagccgaaatgaccagcaagcaccaggagtacttgaagctagagaccacctggatgacggcagtcggcctgtcagagatggctgcggaggccgcctatcagaccggcgctgaccaggcttcaatcaccgctcgcaaccacatccagctggtgaagctccaggtcgaagaagttcaccagcttagtcgtaaggccgagaccaagctggccgaagcgcagatcgaggaactccgccagaaaacccaggaagagggggaggaacgagctgaatctgagcaggaggcatatttgagggaggac

SEQ ID NO: 32652 - DNA, 717 bp, Artificial Sequence
  Description of Artificial Sequence: Synthetic coding sequence
atggccgcactcaagagctggttgagccgctcagtgacctccttctttagatacagacaatgcctctgtgtcccagtggttgccaactttaagaagaggtgtttcagcgagcttattcgtccttggcataagactgtgaccattggatttggagtcactctgtgtgccgtgcccatcgcgcagaagtctgaacctcattcgctgtcgtccgaagcattgatgcggcgggccgtctcccttgtgaccgacagcacctctacgtttctgtcgcagactacttatgcacttatcgaggcaataacggaatacactaaggcggtttacacgcttacgtccctttaccgccagtacacctcactgctggggaagatgaactctgaagaagaagatgaagtctggcaggtgattatcggagcgcgagctgagatgactagcaagcaccaagagtacttgaaacttgaaaccacctggatgactgcggtgggcctgtcggaaatggcagcagaagcagcctaccagaccggcgctgaccaagcatcgatcacggctagaaatcacattcagctggtcaaactccaggtcgaggaggtgcatcaactgagccgcaaagctgaaacgaagctcgcagaagcacaaattgaggaactccgacaaaaaactcaagaggagggtgaagagagagccgaatccgaacaggaggcatacctccgggaagat

SEQ ID NO: 32653 - DNA, 717 bp, Artificial Sequence
  Description of Artificial Sequence: Synthetic coding sequence
atggccgcattgaagtcgtggctttccaggtcagtgacctccttctttcgttacagacagtgtctgtgcgtgccagtggtcgctaatttcaagaagcggtgtttctccgagctcatcaggccctggcataagaccgtgacgataggatttggtgtgactctgtgtgccgttccgatcgcacaaaagtcggagcctcactcgctttcatctgaagcattgatgcggcgggcagtcagcctcgtgactgactccacttcgacctttctgtcccaaaccacgtatgccctgattgaggccattactgagtacaccaaggcagtgtacacgcttacctccctgtaccgtcaatacacctcgctccttggaaaaatgaactcggaagaagaagatgaagtgtggcaagtgatcatcggagcacgagctgaaatgacctcgaagcaccaggaatatctgaaattggaaacgacgtggatgactgcagtgggcctgagcgagatggctgcagaagccgcttaccagaccggggccgatcaggcatcgattaccgccagaaaccatatacaactggtgaagctccaggtggaagaagtccaccagctgtccagaaaagctgaaacgaagctggccgaggcccagatcgaggagctgcgtcagaaaacccaagaagaaggagaagaacgggccgagtcagaacaggaagcgtaccttagagaggat

SEQ ID NO: 32654 - DNA, 717 bp, Artificial Sequence
  Description of Artificial Sequence: Synthetic coding sequence
atggcagcgctgaaaagttggctgagccgctcagtcacttcctttttccggtatcgccaatgcttatgtgtacccgtcgttgccaatttcaagaagcgctgtttttccgaactgatccgcccgtggcacaaaaccgtgactattggtttcggcgttaccttgtgtgcagtcccaattgcccagaagagtgagcctcacagcctgtcgtctgaggccctcatgcgacgggcggtgtctttggtcaccgactctacgtccacatttctgagccaaactacgtatgccctgatagaggccatcactgagtacacaaaggccgtgtatactcttacttctctgtacagacagtacacatctctgcttggcaagatgaacagcgaggaggaagacgaggtgtggcaagtgattattggggcgcgggcagagatgacttccaagcatcaggagtatctgaagctggaaactacatggatgaccgccgtggggctgagtgaaatggcagctgaagccgcataccagactggcgccgatcaggccagcataacggctaggaaccacattcagttggtgaagctccaagtggaggaagtccaccaactctcccgaaaggcagagacaaaactggccgaagcccaaatagaggaactgcgacagaaaacacaagaggaaggtgaggagcgcgcagagtccgagcaggaggcgtacctgagagaggat

SEQ ID NO: 32655 - DNA, 717 bp, Artificial Sequence
  Description of Artificial Sequence: Synthetic coding sequence
atggccgccctgaaaagctggctttcacgttcggtcacttccttttttcggtaccggcagtgcctctgtgtgccggtcgtggcaaactttaagaaacggtgcttttcggaactcatcagaccttggcacaaaacggtgaccattggatttggagtcaccctttgtgcggtgcctattgcacagaagtctgaacctcactccctttcgtcggaagcacttatgagaagagcagtgagcctggtgactgattcgacctccacgttcctgtcacaaactacctacgcgctgatcgaggcaattactgagtacacgaaggcggtctacactctgaccagcctttatcgacagtacacctccctccttgggaaaatgaactccgaagaggaagatgaggtctggcaggtcattataggtgcacgcgcggagatgacgtctaagcatcaggagtacctcaagttggaaaccacctggatgactgccgtgggcctttcggaaatggcagcagaggcggcgtaccaaactggtgcagatcaagcatcgatcaccgcgagaaatcacattcagctggtgaagctgcaggtggaagaggtccatcagctgtcaaggaaggcagaaaccaagctcgccgaggcacagattgaagagcttcggcaaaagactcaagaagaaggcgaagagcgcgctgaaagcgagcaggaagcatacctccgcgaagat

SEQ ID NO: 32656 - DNA, 717 bp, Artificial Sequence
  Description of Artificial Sequence: Synthetic coding sequence
atggccgccctgaagtcttggctgtcaaggagtgttacttccttcttccgctatcggcagtgcctgtgtgtccctgtggtggccaatttcaaaaagcggtgtttcagcgagctgatccgcccctggcataagactgtgacaatcggctttggcgtgacactgtgtgctgttccaatcgcgcagaagagcgaaccccatagcctctcaagcgaggccctaatgcgaagggccgtatccttggtcaccgactctacaagcactttcttgagccagacaacatacgctctgatcgaggcgattactgagtacacaaaggccgtttataccctgacgagtctctatcgacaatacacatctctgctcggcaagatgaacagcgaggaagaagatgaggtatggcaggtgattattggggctcgagcggagatgacatccaagcaccaggagtaccttaaacttgagacaacatggatgaccgctgttggcctgagcgagatggccgcggaagcggcttatcagaccggggccgaccaggcgtctatcacggcccgcaaccacatccagctcgtgaaactccaggtggaggaggttcaccaactgagcagaaaagcggaaacaaagctcgcagaggcccagatcgaagagctgagacaaaagacccaagaggagggtgaagaaagagctgagtctgagcaggaagcctacctgcgggaggat

SEQ ID NO: 32657 - DNA, 717 bp, Artificial Sequence
  Description of Artificial Sequence: Synthetic coding sequence
atggcggctctgaagtcctggctgtcccggtctgtgacttctttttttagatataggcagtgcttgtgcgtgccggtggtggcaaacttcaaaaagcgctgtttttctgagttgatcagaccctggcacaaaacagtgacaatcggattcggagtcacactttgcgccgtccccattgctcagaaatctgaacctcacagtctgagttcggaggcccttatgcgaagagccgtttccctggtgactgattctacttccacctttttgtctcagacgacatatgcccttatcgaggcgataacagagtatacaaaagccgtctatacgctcacatcgctgtaccgtcagtatacttctctattgggtaaaatgaattctgaagaggaggacgaagtgtggcaggtgatcatcggagcaagggcggagatgacatcaaagcaccaggagtatctgaaactggaaacgacttggatgaccgccgtcggcctgtctgagatggccgcggaagccgcctaccaaacaggagctgatcaggcatcgataacggcccgtaaccatattcagctggtcaaactgcaggtagaggaggtgcaccagttgtcaaggaaggccgaaaccaagctggctgaggctcagatcgaggaactcagacagaaaacccaggaggagggtgaggaacgcgccgaatcagaacaagaggcgtacctgcgagaggac

SEQ ID NO: 32658 - DNA, 717 bp, Artificial Sequence
  Description of Artificial Sequence: Synthetic coding sequence
atggcggcactgaagtcgtggctgtcacggtccgtgacctcgtttttccgctatcgccagtgcctgtgtgtgcctgtcgtcgcgaacttcaagaaaaggtgctttagcgagttaatccgtccctggcacaagacagtgacaataggcttcggcgtaaccctctgcgcggtgccgatcgctcaaaagtcggaaccccactctctgagctccgaagctctgatgaggcgcgcggtcagtctcgttaccgactcgacatccactttcctgtcgcaaacgacctacgccctaatcgaggctatcaccgagtacactaaggccgtatatactctaacaagcctgtatcgacaatacaccagccttttgggtaagatgaactcagaagaagaagatgaagtctggcaggtgatcattggagcgagagccgagatgacgtcgaagcaccaagagtatcttaagctggagaccacctggatgactgcggtgggcctgtcggagatggctgccgaagctgcctatcagacaggagcagatcaggcgtctatcacagcccgtaaccacatccaactggtgaaacttcaggttgaggaggtgcatcagctgtctcgtaaggccgagacaaaattagccgaagcccaaatcgaagagctgcgccaaaagacgcaggaggagggtgaggagcgcgccgagagtgagcaggaggcgtatctaagagaagat

SEQ ID NO: 32659 - DNA, 717 bp, Artificial Sequence
  Description of Artificial Sequence: Synthetic coding sequence
atggctgcgcttaaaagttggttaagtcggagtgtgacctcttttttcagataccggcaatgtctgtgtgtcccagtggttgccaatttcaaaaagcggtgcttcagcgagcttatcaggccgtggcataagactgtgacgattggatttggggtgacactatgcgcagtccccatcgcacagaaaagcgaacctcacagcctgtcctccgaggcacttatgcgtagggccgtgagcttggtaaccgattcgactagcacatttttgagccagaccacctatgcgctaattgaagcaataacagaatacacaaaggctgtatatacactgactagcctttacaggcagtatacctccctcctgggcaaaatgaacagtgaggaggaggacgaagtctggcaggtcattatcggagctagggctgaaatgacaagcaaacatcaggaataccttaagctggagactacttggatgactgcagtcggcctttcagagatggcggctgaagctgcatatcaaacgggcgctgatcaggcgagtataaccgccaggaaccacattcagcttgtgaaactgcaggtggaggaggtacaccaattgtccagaaaagccgagacaaagctcgcggaagcgcagatcgaggaacttagacagaaaacgcaggaggaaggtgaggaacgcgccgagtcagagcaggaggcctatcttcgtgaggac

SEQ ID NO: 32660 - DNA, 717 bp, Artificial Sequence
  Description of Artificial Sequence: Synthetic coding sequence
atggctgctctgaaaagctggttgtcaagatctgtgacgtccttctttagataccggcagtgtctctgtgttccagttgtcgccaacttcaaaaagcgatgtttttcagagctaatcaggccgtggcataagactgttactatcggattcggagttaccctctgcgctgtgcctatcgcacagaaatccgagccgcattccctctcgagtgaagccctgatgaggcgcgcagttagtcttgttaccgactctacctccacattcctctctcagaccacctacgctcttatcgaggcaatcaccgagtacacaaaagccgtttacaccttgaccagtctgtatagacagtatacatctcttttgggaaaaatgaacagtgaggaggaggatgaagtgtggcaggtgatcatcggagctagggccgaaatgactagcaagcatcaagagtacctaaagctggaaaccacttggatgaccgctgtgggactctcagagatggctgcagaggcagcatatcagacaggcgcagatcaggcatctatcactgctagaaatcatatccaactagtaaagctgcaggtggaagaagttcatcaactttcccgtaaggccgaaactaagctcgccgaagctcagatcgaggaacttcgtcaaaaaactcaggaggagggagaagaaagggcagagagcgagcaggaagcttatctgcgtgaagac

SEQ ID NO: 32661 - DNA, 717 bp, Artificial Sequence
  Description of Artificial Sequence: Synthetic coding sequence
atggcggctctcaagagttggctgagccggagcgtgacatcatttttccgctatcgccagtgcttatgtgttcctgtggtggctaattttaaaaagcgatgcttcagtgaactgatcagaccctggcacaagacggttaccataggttttggggttaccctctgtgctgtgcccattgcccagaagagtgaaccccatagcttatcttccgaagccctgatgcgtagggcggtctctctggtgaccgattccacaagcacttttctgagccagaccacttacgccctcatcgaggcaataaccgaatatacgaaggctgtttatactttaacctccctttatcgacaatatacaagcctgctagggaagatgaattctgaagaagaagacgaagtgtggcaggtgatcattggggcaagagcagaaatgacttccaaacaccaagaatatctgaagctggagaccacttggatgacagcagtcggactttcagagatggcggcagaagctgcgtaccagacgggagctgaccaggctagcatcaccgctaggaaccacatccagctggtgaagctccaggtggaagaggtgcaccagctgtctcgcaaggctgagaccaagctcgctgaagctcagatagaagagctgagacaaaagacccaggaagagggagaggaaagggccgagtccgaacaagaagcttaccttagagaagac

SEQ ID NO: 32662 - DNA, 717 bp, Artificial Sequence
  Description of Artificial Sequence: Synthetic coding sequence
atggctgccctcaaatcatggctgtcccggagcgtcacctctttctttcggtaccgccagtgcctgtgcgtgccggtggtcgcgaacttcaagaagcgctgtttcagcgaactcatccggccgtggcacaaaactgtgacgatcggattcggagttacgttgtgcgccgtcccaattgcacaaaaatcagaaccgcattcattgtcatccgaagcgctgatgagacgcgcggtgtcgcttgttacggattccacttccacttttctgagccaaactacttacgcccttatcgaagccatcactgaatacactaaggccgtgtacacgctgacctccctctaccggcagtacacttcgctcctcggtaagatgaactcagaggaagaggacgaggtctggcaggtgatcatcggagcccgcgcagaaatgaccagcaagcaccaggaatatctgaaattggaaactacctggatgaccgccgtgggcctgagcgagatggccgcagaggcagcgtaccagactggcgccgatcaggcgagcatcaccgcgcggaaccatatccagctcgttaagctgcaggtggaggaggtccatcagctctcgaggaaagcagagactaagctggcagaggcacaaatcgaggaactgcgccagaaaactcaggaagagggagaggaacgagcagaatcagaacaagaagcctacctccgcgaggac

SEQ ID NO: 32663 - DNA, 717 bp, Artificial Sequence
  Description of Artificial Sequence: Synthetic coding sequence
atggccgctctcaaaagttggctgtcccggtccgtaacgtctttcttcagatatcgacaatgcttatgtgtgcccgtcgtggccaatttcaagaagcgatgtttttctgagttaattcgcccgtggcacaagacagtcaccataggcttcggagttacactgtgcgccgtacccatcgcgcagaaatcagaaccccattccctgagtagtgaggccctcatgagaagagccgtctccctcgtgactgactcaacctcaaccttcctgtctcagaccacctacgcactgatagaagccatcacagaatacaccaaagccgtttacaccctgacctccctgtaccggcagtacacaagtttgcttggcaagatgaattcagaagaagaggatgaggtgtggcaggttattatcggggctcgcgccgaaatgaccagcaaacatcaggagtatttgaaattggaaaccacatggatgactgcggttggactgtcagagatggctgcggaggctgcataccagacgggtgcggatcaggcctctatcactgcacgcaaccatattcagttagtgaaactgcaggtcgaagaagtgcatcagctgtcacggaaggccgagactaagctggccgaagcgcagattgaggagttgaggcagaagacgcaggaggaaggagaggagagagccgaaagtgaacaagaggcgtacctgcgtgaggac

SEQ ID NO: 32664 - DNA, 717 bp, Artificial Sequence
  Description of Artificial Sequence: Synthetic coding sequence
atggcggctctgaagtcatggttgtctcgcagcgtgacctcattcttccgatacaggcagtgtttgtgcgtacctgtggtggccaacttcaaaaaacgatgcttttccgagctgatcaggccctggcacaaaacagtgaccataggattcggagtgaccctttgcgctgtgcccattgcccagaaatccgagccacactcactgtcgtccgaggccttgatgcgcagagctgtgagtctcgttacggatagtaccagtacatttttgagccagactacatacgctctaattgaggctatcacagaatacactaaggcagtatatactctgactagcttatacagacagtatacatctctgctagggaaaatgaattcagaagaggaagacgaggtatggcaggtcattatcggagccagggccgaaatgacctcaaaacatcaggagtatctgaagctggaaaccacctggatgacggccgtgggactcagtgagatggccgcagaggccgcctatcagacaggggccgaccaggcaagtatcacagcccggaaccatatccagcttgtaaaactacaggtggaagaagttcaccagttatctaggaaggctgagacaaagttggctgaggcgcagatcgaggagctgagacaaaagacacaggaagagggcgaagaacgagcagagagcgagcaagaagcctatctccgggaggac

SEQ ID NO: 32665 - DNA, 717 bp, Artificial Sequence
  Description of Artificial Sequence: Synthetic coding sequence
atggccgccctcaagagctggttgtcgcgttctgtgactagcttctttcggtaccggcaatgcctgtgcgttcctgtcgtggcgaatttcaagaagcggtgtttcagcgaactgatccgcccgtggcataagaccgtgactattggctttggagtgaccctgtgcgcagtgccaatagcgcagaagtcagagccgcactcactgagctcggaggcactcatgcgcagagccgtctccctggttaccgactccacgtccaccttcctctcacagactacgtacgccctgatcgaagcaatcactgaatacaccaaagcggtctacacgttgacctccctctatcggcaatacacttcgctcctggggaagatgaacagtgaggaagaagatgaagtctggcaggtgatcatcggtgcgcgcgctgaaatgaccagcaaacaccaggagtacctgaagctggaaaccacctggatgaccgcggtcggcctgagcgaaatggcagctgaagcggcctatcagactggagccgatcaggcgagtatcaccgcccggaaccacattcaactggtgaagctgcaggtggaagaggtccatcagttgtccaggaaagccgaaactaaacttgccgaggcccaaatcgaggaactccggcaaaagactcaggaggagggagaggagcgcgcagagtccgaacaagaagcatacctcagagaggat

SEQ ID NO: 32666 - DNA, 717 bp, Artificial Sequence
  Description of Artificial Sequence: Synthetic coding sequence
atggctgctttgaaatcttggctttccagatcggtcacgtcattctttcggtaccgacaatgcctgtgcgtacccgtggtggcaaatttcaagaaaagatgttttagcgagcttattcgaccttggcataagactgtcacgattgggttcggtgtcaccttgtgcgccgtccccattgcgcaaaagagcgagccacattctctgtcctctgaagcactgatgcgccgtgcagtgtcactagtgactgactccacttccaccttcttaagccaaactacatatgccctgattgaggcaatcacagagtacacgaaagctgtctacaccttgactagtctctaccggcagtatacttccttgctgggcaagatgaattcagaggaggaggatgaagtgtggcaggttatcattggggcacgcgctgagatgacctccaaacatcaggagtacctgaagctggagaccacatggatgactgccgtcggtctgagtgagatggctgctgaagctgcataccagacaggtgccgaccaggcttcgatcactgcccgcaatcatatccaacttgtcaagttacaggtcgaagaggtccaccagctatcaagaaaagctgagactaagctggctgaggcccagatagaggaactgcgccagaagacacaggaagagggcgaagaacgggccgagtccgagcaggaggcctatctgcgagaggat

SEQ ID NO: 32667 - DNA, 717 bp, Artificial Sequence
  Description of Artificial Sequence: Synthetic coding sequence
atggccgcacttaagagttggctgagccggagcgttacctcttttttccgctatcgacagtgcttgtgcgtcccagtcgtcgcgaatttcaagaagcggtgttttagtgagctgatacggccctggcataaaacagtgactatcggtttcggcgtcacgttatgtgcggtccctattgcgcagaaaagcgaaccccatagtctgtcaagcgaggcactgatgcgacgggccgtttcacttgtgaccgatagcacgtcaacctttctgtcacagacgacctatgcactgatagaagctatcaccgagtatacgaaggccgtgtatacccttacctcactgtacagacagtatacgtctctgctgggaaagatgaacagtgaggaagaagacgaggtgtggcaggttatcatcggggcccgagctgaaatgaccagtaaacaccaggaataccttaagttggaaaccacttggatgacagccgtgggtttaagcgaaatggccgctgaagctgcataccaaacaggggctgaccaggcaagcattacagcgcgcaaccatatacagttggtgaaacttcaggtggaggaggtgcatcaattaagcaggaaggctgagacaaaactcgcggaggcccagatcgaagagctgagacagaaaactcaagaggagggcgaagaaagagccgagagcgaacaggaggcctacctacgtgaagat

SEQ ID NO: 32668 - DNA, 717 bp, Artificial Sequence
  Description of Artificial Sequence: Synthetic coding sequence
atggcggcgcttaaaagttggctatccagatccgttacttcattttttcgctatagacaatgcctctgtgtccctgtcgtggccaacttcaaaaagcggtgcttttccgagctcattagaccatggcacaagactgtgacgatcgggtttggagtgactctgtgcgcagtgccgattgctcagaaatcagaaccccactcactgagtagtgaggccctgatgcggcgggccgtgagcttagtcacggactccactagcaccttcctctctcagacaacttatgctctgatcgaagcaatcacagagtacacgaaggccgtgtacaccttaacctctctgtacaggcagtatacatctttactgggaaagatgaacagtgaagaagaggatgaggtgtggcaggtaatcatcggagccagagccgagatgacctctaagcatcaggagtatttaaaactcgaaactacatggatgacagccgtggggttgtcagagatggctgcagaggcggcctaccagaccggggctgatcaggcctctatcacagccaggaaccacatccagctggtaaagctacaggtggaagaggtacaccaactctccagaaaggctgaaacaaagctggcagaggcccagattgaagagcttcgtcagaaaacacaggaggaaggtgaggagcgggctgaaagtgagcaagaagcctatttgcgcgaggac

SEQ ID NO: 32669 - DNA, 717 bp, Artificial Sequence
  Description of Artificial Sequence: Synthetic coding sequence
atggcagctttaaaaagttggttgtctcgttcagttacctctttcttcagatatagacagtgtctttgcgtcccagtcgttgcaaacttcaaaaaaagatgtttctctgaattgattagaccctggcacaagactgtaacaattggttttggtgttactttatgtgccgtccccattgctcaaaagagtgaaccgcactctctaagttctgaagcccttatgagacgtgccgtttcgctcgttactgactcaacttctacctttctgtctcaaactacgtatgcgttgattgaagcaatcactgaatataccaaggctgtttacacactcacctctctttatcgtcaatacacttctcttctgggcaagatgaactccgaagaagaagatgaagtttggcaagtaatcattggggcacgtgctgagatgacatcgaagcatcaagaatatctgaaacttgaaacaacttggatgacggcagtggggctgtctgaaatggccgctgaggcagcctatcaaactggagcggatcaagcttccattactgcgcgaaatcatattcagcttgttaagttacaagtggaagaagtccatcaattgagtagaaaagcagaaacaaaattggcagaagctcaaattgaagagctacgccagaagacacaggaggagggagaagagcgagccgagtcggagcaagaggcgtacttgagagaagat

SEQ ID NO: 32670 - DNA, 717 bp, Artificial Sequence
  Description of Artificial Sequence: Synthetic coding sequence
atggcggcacttaaatcttggctttcacggagcgttacttctttcttcaggtatagacagtgcctctgcgtcccagtagttgcaaactttaaaaaaagatgctttagcgaacttatcaggccctggcataaaaccgtaaccattggatttggcgtaaccctttgcgctgtgcccatcgctcaaaaaagcgaaccccacagcctttcttctgaggcccttatgcggcgcgcagttagcctggtcaccgactccacttctaccttcctcagccagaccacttatgctctgatcgaggctatcactgaatacactaaggcagtgtacacactgacctcgctgtatcgtcagtacacttctctactgggaaaaatgaatagcgaggaagaggacgaggtctggcaagtcattatcggggccagggccgaaatgacttcgaagcatcaagaatatcttaagcttgaaactacttggatgaccgcagtgggactgtctgagatggcggctgaagcagcctatcagaccggcgcggaccaggcttctataaccgccaggaaccatatccagcttgttaaattgcaagtggaggaagtgcatcaactcagtagaaaagctgagactaagctggcagaagctcaaattgaagaacttcggcagaagacccaggaagagggagaagagagagcagaatccgaacaagaggcctacctgagggaagac

SEQ ID NO: 32671 - DNA, 717 bp, Artificial Sequence
  Description of Artificial Sequence: Synthetic coding sequence
atggccgccttgaaatcctggctgtcccgttctgtgacttccttcttcagataccgccagtgcctttgcgttccagtcgtggctaatttcaagaagcgctgtttttccgaactgattcggccgtggcataagaccgtgactatcggcttcggcgttaccctgtgcgcggttcccatcgctcagaagtctgagccgcactcgctctcttccgaggctctgatgagaagggccgtttccctggtgaccgatagcacctccactttcttgagccagaccacatatgctctaatcgaagcaatcaccgagtacacaaaggcagtgtacaccctgactagtctgtaccggcagtatacttcactcttggggaaaatgaactcggaagaggaggacgaggtatggcaggtgattattggagctcgtgccgagatgacctccaagcaccaagagtatctgaagctggagaccacgtggatgacagccgtggggctgtctgagatggcggcggaagctgcctatcagacaggcgccgaccaggctagtatcacagcccgcaatcacatccagctcgtcaagttacaggtggaagaggtgcatcagctgtctagaaaggctgaaacaaaactcgccgaggcacagatcgaagagctgaggcagaaaacacaagaagaaggcgaagagcgagctgagtctgagcaagaggcctatttgcgcgaggac

SEQ ID NO: 32672 - DNA, 717 bp, Artificial Sequence
  Description of Artificial Sequence: Synthetic coding sequence
atggccgcattgaagtcctggctttcacggtccgtcactagcttcttccggtaccgtcaatgcctgtgtgtgcccgtcgtcgcaaactttaagaaaaggtgtttctctgaacttatccggccctggcacaaaaccgtgaccattggctttggagtgaccctctgcgcagtgccaattgcacaaaagagcgagcctcatagcctgagctcagaggcgctgatgcggagggctgtgagcctggtcaccgattcgacctcgacttttctgtcacaaaccacctacgcgctcattgaagcaatcaccgaatacaccaaagctgtgtacactctcacctcgctttaccgccaatacacttccctgctgggaaagatgaattccgaggaggaggatgaggtctggcaggtgattatcggggcgagggcagagatgacttccaagcaccaagaatacctgaagctggagacgacgtggatgactgcagtgggactttccgaaatggcagccgaagcggcataccaaacgggagcagaccaagcatcgattaccgcgaggaatcatatccagcttgtgaaattgcaggtggaagaagtgcatcagttgtcccgaaaggccgaaaccaagctcgcagaagcccaaattgaagagctgagacagaaaactcaggaagagggagaagaacgtgcagaatcggaacaagaagcctacctgcgagaggac

SEQ ID NO: 32673 - DNA, 717 bp, Artificial Sequence
  Description of Artificial Sequence: Synthetic coding sequence
atggcagcacttaagtcctggctgtccagaagcgtcacctccttctttaggtaccgccaatgcctctgcgtgcccgtggtcgccaactttaagaagcggtgtttttcggaacttatccggccttggcataagactgtcactattggttttggggtgactctctgtgcagtgcctattgcccagaagtcagaaccgcactcactctcgtccgaggccctgatgagaagggcggtgagcctggtgaccgactccacctcaaccttcctgtcgcagacgacttatgccttgatcgaggcaatcactgagtacaccaaagcggtctataccctgacgagcctgtaccgacaatatacgtcgttgctggggaagatgaacagcgaagaggaggatgaagtctggcaagtgataatcggagcaagagcggaaatgacctcaaaacatcaagagtaccttaagctggaaaccacttggatgactgctgttggtctgtcggagatggccgccgaagcagcttaccaaaccggagcagaccaggctagcattacggcacgcaatcatattcagttggtgaagttgcaggtggaagaagttcatcaactgtcgaggaaggcggagactaaacttgcggaagcccagatagaagaacttcggcaaaaaacccaggaagaaggcgaggaacgcgcggagtcagaacaagaggcatatctgcgagaggat

SEQ ID NO: 32674 - DNA, 717 bp, Artificial Sequence
  Description of Artificial Sequence: Synthetic coding sequence
atggctgcactgaagtcctggctgtccagatctgttacatctttcttccgatatcggcagtgtctctgcgtgccagtggtagccaactttaagaaacgctgcttttcagaactgattcggccatggcataagaccgtgacaattggtttcggagtaacattgtgcgcagttcctatagcacagaagagtgaaccacattcactgagttccgaggcccttatgcgaagggccgtgtccctcgtgaccgactctactagtactttcctttctcagaccacctacgccttgattgaagccatcacggaatacacaaaggctgtttacacactgacttctctttatcgacagtacacctccttgctgggcaagatgaattcagaggaggaggacgaagtgtggcaagtgatcattggcgcgagagctgaaatgacctctaaacaccaagagtaccttaaactggagactacttggatgacagctgtggggctctctgagatggcagccgaggcggcctaccaaacgggcgcagaccaggctagtatcactgcaagaaatcatattcagctggtcaagctccaagtagaagaggtgcatcagctgtctcggaaggccgaaacgaagctggccgaggcccaaatagaggagcttagacagaaaacgcaagaggagggggaagaacgggccgaatccgaacaggaggcctatctgcgggaggat

SEQ ID NO: 32675 - DNA, 717 bp, Artificial Sequence
  Description of Artificial Sequence: Synthetic coding sequence
atggccgcgcttaagagctggctgagccggagcgtgacctcttttttccgctaccgccaatgcttgtgcgtccctgtggtagctaacttcaagaagcggtgcttttctgagctgatccggccgtggcacaagactgttaccatcggattcggggtaaccctctgtgcggtgccaatcgcccagaaatcagagccgcattcgttgtcgtcggaggcactcatgagaagagccgtgtcgctcgtcacggactcaaccagtactttcctttcacaaacgacttacgccctgattgaagccatcaccgaatacaccaaggctgtgtacaccctcacctccctgtaccggcagtacacttcactgctgggaaagatgaatagcgaggaagaggatgaagtgtggcaggtgattatcggggcaagggccgagatgacgagcaagcaccaggagtatctgaaactcgagactacttggatgaccgccgtgggactgtccgagatggcggcggaagctgcctaccagaccggcgcagaccaggcctcaatcaccgcccgcaaccatatccaactcgttaagctccaggtcgaagaggtgcaccaattgtcgcgcaaggcggagactaagctggcggaagcgcagatcgaagagttgcgccaaaaaactcaggaagaaggcgaggagcgagcagaatccgaacaagaagcatacctccgtgaagat

SEQ ID NO: 32676 - DNA, 717 bp, Artificial Sequence
  Description of Artificial Sequence: Synthetic coding sequence
atggcagcgctcaagtcgtggctgtcccgctcggttacttcgttcttccgctaccgccaatgtctctgcgtaccggtggtcgcgaacttcaagaagcgctgtttctcagagctgattaggccatggcacaaaactgtcaccatcggatttggagtgactctgtgcgccgtcccgattgcacaaaaatcagagccacatagcttgtcgtctgaggcgctgatgcgaagggccgtgtcgctcgtgaccgacagcacctcgacctttctttcacagacgacctacgcgctcatcgaggccatcactgaatatactaaggcagtatacaccctgaccagcttgtaccgccagtacacttcgctgctggggaagatgaattcagaggaagaagatgaagtgtggcaggtgatcatcggtgcccgcgcggaaatgacttcgaaacatcaagaatacctgaagttggagacgacctggatgaccgctgtcgggctgtctgagatggctgccgaagccgcctaccagaccggagccgaccaagcctcaatcaccgccagaaaccacattcagctcgtgaagctgcaggtggaagaagtgcaccaactgtcgcgcaaagcagaaactaagctggcagaagcacagatcgaggagctccggcaaaagactcaagaggagggagaagagcgcgcggagtcagaacaggaggcgtacctgcgggaggat

SEQ ID NO: 32677 - DNA, 717 bp, Artificial Sequence
  Description of Artificial Sequence: Synthetic coding sequence
atggcagcacttaaatcatggctgtcccggagcgtcacctcatttttcagatacaggcagtgcttgtgtgtgcccgtggtggcaaactttaagaagagatgtttttccgaacttattagaccatggcataagaccgtcactattggctttggagttactctttgtgccgtgccaatcgcccagaaatcagaaccacactccctttcaagcgaagctctgatgcggcgggccgtgtcgcttgtgactgactcgaccagcacttttctgtcgcagactacctacgcactcattgaggcaattaccgagtacactaaggcagtgtacaccctgacctcgctttaccgccaatacactagccttttgggtaaaatgaatagcgaggaagaagatgaagtctggcaagtgatcattggggcacgggctgagatgactagcaagcatcaggaatacctgaagctggaaactacctggatgaccgcagtgggactgtcagaaatggcagctgaagcagcataccagactggagccgatcaagcatctatcactgcacgaaaccacattcaactggtcaagctgcaagtcgaagaagtccatcagctctccaggaaggcagaaactaaactcgccgaagcacagatcgaagagcttcgacagaaaactcaggaggagggagaggaacgcgcggaatcagaacaggaggcatacttgagagaggac

SEQ ID NO: 32678 - DNA, 717 bp, Artificial Sequence
  Description of Artificial Sequence: Synthetic coding sequence
atggccgcgctgaagtcctggttgtccaggagcgttacttctttcttccgatacaggcagtgtctgtgcgtaccagtggtggccaattttaaaaagcgttgcttttcagagctgatccgtccctggcataagacagtgacaatagggttcggagttaccctctgtgccgtccccatcgcgcaaaaatccgagccacattctctctcttcagaggcccttatgagacgcgccgtgtccctggttacagattccacatccactttcctgagccagacgacttatgccctgattgaggcaatcacagaatacaccaaagcagtgtatactttgacaagtctctataggcagtacacttctctgctcggaaagatgaattctgaagaagaggacgaggtttggcaggtgattattggagctcgggctgagatgacaagcaagcatcaggagtatctgaaactggagactacctggatgacagctgttggactgtctgagatggcagccgaagcggcataccagaccggcgccgaccaggcttccataaccgcccggaaccacatacagcttgtgaagctccaggtcgaggaggtacatcagctttcgcgcaaggctgagacgaaactcgctgaggctcagattgaggagctgagacagaaaactcaggaggagggggaggaacgggccgagagcgagcaggaggcctacctgagagaggat

SEQ ID NO: 32679 - DNA, 717 bp, Artificial Sequence
  Description of Artificial Sequence: Synthetic coding sequence
atggccgcgcttaagtcttggctgagtcgatctgtcacgtcgtttttccggtacagacaatgcctctgtgtgcccgtggtcgctaactttaagaagagatgttttagcgaactgataagaccatggcataaaactgtgactatcggttttggagtgacgctgtgtgccgtgcctattgcccagaagagcgaaccgcattctctctcaagcgaggcactcatgcgtcgggcggtgagcttggtgactgattccaccagtaccttcctctcgcagacgacctacgcgctcatagaagcgattactgaatacacgaaggctgtttacactctgacttccctttataggcagtacacctcgcttcttggtaagatgaacagcgaagaagaggatgaagtgtggcaggtgattattggtgccagggcagaaatgacctcaaaacaccaggaataccttaaactcgagactacctggatgaccgcagtcgggctgtcagaaatggcagccgaagcggcctaccaaaccggagcagaccaggctagcatcactgcaaggaatcatattcaacttgtcaagctgcaagtcgaggaggtgcaccaattgtcacgcaaggcggaaaccaaacttgcagaagcacagatagaagagttgagacaaaagacccaagaagagggagaagaacgagccgaaagcgagcaggaggcatacctgcgggaggac

SEQ ID NO: 32680 - DNA, 717 bp, Artificial Sequence
  Description of Artificial Sequence: Synthetic coding sequence
atggccgcattgaaaagctggctgtccaggtcagtaacttccttcttccgctaccgccaatgcttatgcgtccccgtagtcgccaacttcaagaaaaggtgtttcagcgagctgattaggccttggcacaaaaccgtaacgatcgggttcggggtgaccctatgcgcagtcccaatagcccagaaaagcgaaccccattccctgtcctctgaagctcttatgcgcagagccgtttctctcgtcaccgattccacctcgacattcctgagtcagacgacatatgctctcatcgaggctataactgaatacacaaaggcggtgtacaccctaacatccctgtataggcagtacaccagcctactgggaaagatgaactccgaggaagaggatgaagtttggcaggtgatcattggcgctagggcggagatgacttccaagcaccaggaatacttgaaattggaaacaacctggatgacggccgtggggctgagcgagatggctgcagaggctgcataccagactggggctgaccaggccagtatcaccgctcgtaaccatatccagctcgttaagttacaggtagaggaggtgcatcagctcagccggaaagccgagactaagctggctgaggcacaaatcgaggagctcagacagaagacacaggaagagggagaagaaagagcggagtcagaacaggaggcctatcttagagaggac

SEQ ID NO: 32681 - DNA, 717 bp, Artificial Sequence
  Description of Artificial Sequence: Synthetic coding sequence
atggccgcactgaaatcctggttgtcgaggtccgtgacctccttcttcagatatcgccagtgcttgtgcgtcccagtggtcgccaactttaagaagcgctgtttctctgaactgattagaccctggcataaaacagtgaccatagggtttggggtgacactgtgcgcggtgccaatagcccagaagagtgagcctcacagtctgtcaagcgaagctctaatgcgacgggctgtctcattggtcaccgattccacatctaccttccttagtcagactacctacgctctcatcgaagctataacggagtataccaaagctgtttataccctaacatccctgtatcggcagtatacgtccctgttagggaaaatgaattcagaggaggaggacgaagtgtggcaggtgatcataggcgcacgagctgagatgaccagcaagcatcaggaatatctgaagctggagaccacatggatgactgctgtcggactgagtgagatggccgccgaagccgcctaccagaccggagcggatcaggcctccattactgctcggaatcacattcagctggtgaaactgcaggttgaggaggtacaccagctttcccgcaaggcggaaacgaagctggccgaggctcaaatcgaagagctccgacagaaaacccaggaagagggtgaggaacgagccgaaagcgaacaggaggcctaccttagggaggac

SEQ ID NO: 32682 - DNA, 717 bp, Artificial Sequence
  Description of Artificial Sequence: Synthetic coding sequence
atggccgctctcaaatcctggctgagccggtctgtgacatctttcttccgatacagacagtgcctctgcgtcccagtggtcgctaattttaagaaacggtgttttagcgagttgattaggccttggcacaagaccgtgaccattggatttggagtcacactctgcgcagttcctatcgcacagaagagcgaaccacactccctgagtagcgaagcactaatgcgaagggctgttagtctggttaccgattccacaagcacttttctaagccagactacctacgctctgatcgaagctatcacagagtacaccaaggccgtttatacactgacctcactatacaggcagtacacatccctgctagggaagatgaattccgaggaagaggatgaagtctggcaggtgataataggggctcgtgccgagatgacctcaaagcaccaggaataccttaagttggaaaccacatggatgaccgccgttgggctaagcgaaatggccgcagaagctgcttatcaaaccggggctgaccaggcttctataacagctcgcaatcatatccaattggtcaagttgcaggtggaagaggtgcatcagctcagtagaaaagctgaaaccaagctcgcagaggcccagatcgaagaactccgacaaaagacacaggaggagggggaagagagagctgaaagtgagcaggaggcttacctgagggaagac

SEQ ID NO: 32683 - DNA, 717 bp, Artificial Sequence
  Description of Artificial Sequence: Synthetic coding sequence
atggccgcgctgaaatcgtggctctcccggtccgtcacctccttcttccggtacagacagtgcctttgcgtgccggtggtggctaacttcaagaagagatgtttctccgagctcatccgtccgtggcacaaaactgtgaccatcggattcggagtgactctgtgtgctgtgccaatcgcacagaagagcgaaccgcactcactttcttcggaggcgttgatgcgccgcgccgtcagcctcgtgaccgactcaaccagcacctttctgtcacagaccacttacgcactcatcgaagccatcactgagtacaccaaggccgtgtacaccctgacttccctgtaccgccagtataccagcctgctgggaaagatgaactcagaagaagaagacgaagtctggcaggtgatcatcggagcccgcgccgagatgacttccaaacaccaagagtacctgaagctcgaaaccacctggatgacggcggtgggcctgtcagaaatggccgcggaggcggcctaccagactggagccgaccaagcgtcaatcactgcccgaaatcatatccaactggtgaagctgcaggtggaagaagtccatcaattgagcaggaaggcggaaactaagctggcggaggcgcaaatcgaggagttgcggcagaagactcaagaagaaggcgaagaacgcgccgagagcgaacaggaggcttacctccgggaagac

SEQ ID NO: 32684 - DNA, 717 bp, Artificial Sequence
  Description of Artificial Sequence: Synthetic coding sequence
atggcggcgctgaaaagctggctgagtagatctgtgacgagctttttccggtacaggcagtgtttgtgcgtgcccgtggtcgctaattttaaaaaaaggtgcttctctgagctaattaggccttggcacaaaaccgtgactatagggtttggcgtaaccctttgtgccgttccgatcgcccagaaatcagaaccacactctctgtccagcgaagccctcatgcgccgagcggtcagcttggtcacggattcaacaagcactttcttaagtcagaccacatatgccctaattgaggcaatcacagaatacaccaaagcggtgtatacactgacctccctatatcggcagtacacctccctgctgggaaaaatgaactccgaggaagaagatgaggtgtggcaggtcatcatcggcgctcgagctgagatgacatcaaagcatcaggagtatttgaagttggagaccacttggatgacggcagtgggactttctgagatggccgccgaggccgcttatcagacaggtgcggatcaagcatccatcaccgctaggaaccacatacaactggtaaaacttcaggtggaagaagtgcaccagctgtcaaggaaagctgagacaaagctggcagaagcccagattgaggagctcaggcagaaaacccaggaagaaggagaagaacgcgcagaaagtgagcaagaggcttatctccgggaagat

SEQ ID NO: 32685 - DNA, 717 bp, Artificial Sequence
  Description of Artificial Sequence: Synthetic coding sequence
atggcagccttgaagagctggctgtcgagaagcgtgactagcttctttaggtaccggcagtgcctgtgcgttccggtggtggcgaatttcaaaaagcgctgcttttccgaactgatccggccctggcataaaaccgttaccatcggcttcggagtcactctgtgtgcagtcccgattgctcagaagtcagaaccgcattcattgtcatccgaggcgctcatgcgccgggctgtctccctcgtcaccgacagcacttctacgttcctttcgcagactacgtacgcgctgatcgaagcgatcaccgaatacactaaagccgtgtacacgctgacctcgctgtacagacagtacacgtcactgctcggcaagatgaatagcgaagaggaggacgaagtctggcaggtgatcatcggtgcgagagcggagatgacctcgaaacatcaggagtatcttaagctggaaacgacttggatgacggcagtgggactctccgagatggccgcggaggccgcataccagactggggccgatcaggcgtcaattacggcgagaaatcacatccaacttgtgaagctgcaagtggaggaagtgcaccagctctcccggaaggccgagacgaagctcgctgaagcccagatcgaagaactgaggcaaaagacgcaggaagagggagaagagcgagcagaatcggaacaagaggcatacttgcgggaggat

SEQ ID NO: 32686 - DNA, 717 bp, Artificial Sequence; identical to SEQ ID NO: 32663
  Description of Artificial Sequence: Synthetic coding sequence

SEQ ID NO: 32687 - DNA, 717 bp, Artificial Sequence
  Description of Artificial Sequence: Synthetic coding sequence
atggcggcgctaaaatcgtggttatcgcgatcggtaacgtcgttttttcgatatcgacaatgtttatgtgtaccggttgtagcgaattttaaaaaacgttgtttttcggaattaatacgaccgtggcataaaacggttacgataggttttggtgttacgctatgtgcggttccgatagcgcaaaaatcggaaccgcattcgctatcgtcggaagcgctaatgcgtcgtgcggtttcgttagtaacggattcgacgtcgacgtttctatcgcaaacgacgtatgcgttaatagaagcgataacggaatatacgaaagcggtatatacgttaacgtcgttatatcgacaatatacgtcgttattaggtaaaatgaattcggaagaagaagatgaagtttggcaagtaataataggtgcgcgtgcggaaatgacgtcgaaacatcaagaatatttaaaattagaaacgacgtggatgacggcggttggtctatcggaaatggcggcggaagcggcgtatcaaacgggtgcggatcaagcgtcgataacggcgcgaaatcatatacaactagtaaaactacaagttgaagaagtacatcaattatcgcgtaaagcggaaacgaaactagcggaagcgcaaatagaagaattacgtcaaaaaacgcaagaagaaggtgaagaacgagcggaatcggaacaagaagcgtatctacgagaagat

SEQ ID NO: 32688 - DNA, 717 bp, Artificial Sequence
  Description of Artificial Sequence: Synthetic coding sequence
atggcggcgttgaagagctggctttcaaggagcgtcacgtcattttttaggtaccgtcaatgcttatgcgtcccagttgttgctaactttaaaaagagatgcttttcagaactcatacgaccatggcacaaaacagtgacaatcggttttggagtaacactgtgtgctgtgccgatcgctcagaaatctgaaccgcattccctcagctcagaggctcttatgcgccgggcggtgtccttagtcaccgattcaacgtcgacattcctttcacagacgacttacgctctaatcgaggctatcacagaatatacaaaggcagtttataccctgacttctctttatcggcagtatacatctctcctgggcaaaatgaacagtgaagaggaggatgaagtctggcaggttataatcggtgctagggcggaaatgacgagcaagcatcaggaatacctgaaacttgagactacttggatgacagcggtcggtctctctgaaatggcagcagaagccgcctaccagactggtgccgaccaagcctcgattactgcacgtaatcatattcaattggttaaactgcaagtagaggaagttcatcagttatccaggaaagccgaaaccaaattggctgaggctcaaatagaggagcttagacaaaagacgcaggaggagggcgaagaaagagcagaatcagaacaagaggcatatctccgggaggac

SEQ ID NO: 32689 - DNA, 717 bp, Artificial Sequence
  Description of Artificial Sequence: Synthetic coding sequence
atggccgctctaaagagctggctcagtaggtccgtaacatccttttttcgatatcgacagtgcctctgcgtgcctgtggtcgccaacttcaaaaagcgatgctttagcgaactgattagaccttggcacaagacggtgacaatcggcttcggagtgactctgtgtgcagtccctatcgctcaaaaatcggaacctcattctctgtcctcagaagcgctgatgaggcgcgctgtatctctggtaacagactctacttccaccttcctcagtcagaccacatatgccctaattgaggccattacggagtacaccaaggcggtctatacattaacatccctgtataggcaatatacaagtttgctgggaaaaatgaattctgaggaggaggatgaagtgtggcaagtaatcatcggagcaagagcagagatgacatccaaacatcaggaatacctgaagctcgaaaccacatggatgaccgctgtgggactgtcggagatggctgcggaggccgcatatcaaaccggcgcagaccaggcctccattacagcgcgcaaccacattcagctggttaagctgcaagtggaggaggtgcatcaactctcccgcaaggctgagactaagcttgccgaggcgcagatcgaggaattgagacagaagacccaggaggagggggaggagagggcagagtctgaacaggaggcctacctgcgggaggat

SEQ ID NO: 32690 - DNA, 717 bp, Artificial Sequence
  Description of Artificial Sequence: Synthetic coding sequence
atggccgcgctgaagtcctggctctcccggtcggtgacttcctttttccgatatcgccagtgtctctgtgtgcctgtcgttgccaatttcaagaagcggtgcttctcggagcttatccggccttggcataagaccgtgactatcggttttggagtgaccctgtgcgccgtcccaatcgcccagaaatcagaaccgcatagcctgagctcggaggcgctcatgcgccgggcagtctcgctggtcactgatagcacgagcaccttcctgtcgcagaccacctatgctctgattgaagctatcaccgaatacaccaaagcagtgtatactctgacctcgctgtaccgacagtacacctccttgcttggaaagatgaactcggaagaggaggatgaagtctggcaggtcattatcggtgcacgtgcagagatgacgtcaaagcaccaggaatacctcaagctggagacgacgtggatgaccgccgtgggcctgagcgaaatggctgctgaagcggcataccagactggggctgatcaggcctcaatcaccgcccgcaatcacatccaacttgtgaagctccaagtggaagaagtccatcaactctctcgaaaggccgaaactaaattggccgaagcgcagattgaagaattgagacagaaaactcaagaggagggggaggaacgcgcagagtcggaacaagaagcatacctgagagaggac

SEQ ID NO: 32691 - DNA, 717 bp, Artificial Sequence
  Description of Artificial Sequence: Synthetic coding sequence
atggccgccctcaaatcttggctgtctcggagtgtaacatcgttcttccgataccggcaatgtttgtgcgtgccagtggttgccaacttcaaaaaacgctgtttcagcgaactcatcagaccgtggcacaagactgtgactatcggatttggcgtcacattatgtgcggtgcccatcgcccagaaatcagaaccccatagcttgagtagtgaagctctcatgcggcgtgcagtaagcctggttaccgactccacaagcacttttttaagccaaacgacctatgcccttattgaggccatcacggagtataccaaagccgtctataccctgaccagtctgtaccgtcaatacactagcctcttagggaaaatgaactcggaggaggaggatgaagtctggcaggtcatcatcggagcaagagccgagatgacgagcaaacaccaggaatatctgaaacttgagacaacttggatgactgctgtcgggctgtctgaaatggccgccgaggccgcgtatcagaccggcgccgatcaggcctctattaccgcccgcaatcacatccagctcgttaagctgcaggtggaggaggtacatcagttgtctagaaaggctgagacaaaattggcagaggcgcaaatcgaggagctgagacagaagacgcaggaggaaggagaggagagggcagagtccgagcaggaagcttatctgcgtgaggac

SEQ ID NO: 32692 - DNA, 717 bp, Artificial Sequence
  Description of Artificial Sequence: Synthetic coding sequence
atggctgctctgaaatcgtggctgtcccgttccgtgacttcattctttaggtaccgtcaatgcctgtgcgtccccgtggtggcaaatttcaagaagcgatgtttttccgaattgatccgaccctggcataaaactgtgaccatcgggtttggggtcactctttgtgcggtcccaattgcacagaagtccgaacctcactcactctcgtccgaggcactgatgcgccgtgccgtgtcactggtcactgactcaacctcgactttcctgtcccagaccacctacgcattgattgaggcaattaccgaatacactaaggccgtctacacccttacgtcgctttaccgccagtacacctccctgctcggtaagatgaactcagaggaagaagatgaagtctggcaggtgattataggagcaagagcggaaatgacttcaaagcatcaagagtacttgaaattggaaaccacttggatgaccgcagtgggcctgtcggaaatggcagcagaagcagcctaccaaaccggggccgatcaggcatcgatcacggctcggaaccacatacagttggtgaagctgcaggtggaggaggtgcatcaactcagtagaaaagctgaaaccaagttggcggaggcacaaattgaagaacttcgacaaaagactcaggaggaaggtgaagagcgcgcagagagcgaacaggaagcctatctcagagaagat

SEQ ID NO: 32693 - DNA, 717 bp, Artificial Sequence
  Description of Artificial Sequence: Synthetic coding sequence
atggcggcgttaaagtcctggctctcgcgtagtgttacctcctttttccggtacaggcaatgcctctgcgtacctgttgtcgccaactttaagaagagatgcttctcggagcttatccgtccctggcacaagacagtgaccattggtttcggtgttaccctgtgtgctgtgccaatcgcccagaagtcggagccccactccctttcatcggaggctctgatgcgccgcgctgtttctctcgttaccgatagcacttctacgttcctgtcacagacaacatatgctctgatcgaggcgatcaccgaatacactaaggctgtctacactctcacctccttgtatcgtcagtacaccagtctactgggtaagatgaactccgaggaagaggacgaagtgtggcaggttatcattggtgcccgggctgagatgacctccaagcaccaggagtacctgaaactcgagactacctggatgaccgcggtcggtctcagcgagatggccgccgaggcggcgtatcaaaccggtgcagatcaggcatctatcactgcgcgcaaccatatccagcttgtcaagctccaggtggaggaggtgcatcagctgtcccgaaaggcagagaccaaactggctgaggcccagatcgaggaactccggcagaagactcaagaggagggcgaggaaagggctgagtccgagcaggaagcctatcttcgggaggac

SEQ ID NO: 32694 - DNA, 717 bp, Artificial Sequence
  Description of Artificial Sequence: Synthetic coding sequence
atggcggcccttaagagctggctctcccggtcagtcacttcctttttcaggtacagacaatgcctttgtgtcccagtggtggcgaactttaagaaaagatgcttctccgaactcatccggccttggcataagaccgtgaccatcggcttcggtgtgaccctctgcgcggttcctatcgcgcagaaatcggagccgcactcactgtccagcgaagcattgatgcgccgcgcagttagcctcgtgactgactcaacgagcactttcctgtcgcaaactacctacgccctgatcgaggctattacggagtacaccaaggccgtgtacactcttacctcactttaccgacagtacacctccctgctgggtaaaatgaatagcgaggaggaggacgaagtgtggcaggtgatcatcggagcgcgcgcagagatgacctcgaaacaccaggagtaccttaaactggaaaccacctggatgactgccgtcggcctgtcggagatggccgccgaggctgcttaccagactggtgccgaccaggcaagcattactgccagaaatcacatccagctggtcaagctccaagtggaagaagtgcatcaactcagccgcaaggctgaaactaaactggctgaagcgcagatcgaggaactgcgccagaaaacccaggaggaaggagaggagcgagccgagagcgagcaagaggcctacctcagggaagat

SEQ ID NO: 32695 - DNA, 717 bp, Artificial Sequence
  Description of Artificial Sequence: Synthetic coding sequence
atggctgcactgaagtcatggcttagccgatctgttaccagcttcttccgatatcggcaatgcctttgcgtgccagtggtggccaacttcaagaaaaggtgtttttctgaactcattcggccttggcacaaaacagtcacaatcgggttcggtgtcacactgtgtgctgttccaattgcacaaaaatccgaaccgcactccctgagttcagaggccctcatgcgccgcgccgtcagcctcgtaacagattcaactagtacgtttctcagccagacaacttatgcactgattgaggcaattactgaatacacaaaggcagtctacaccctgacctccctctacaggcagtacacttcattgcttggcaagatgaacagtgaggaggaagatgaggtgtggcaggttattataggtgcaagggccgagatgacatctaagcatcaggagtacttgaagcttgagacgacctggatgaccgccgtgggactgagtgagatggccgcagaagctgcttaccagacaggcgccgatcaggcctccataactgctcgcaatcacatccagctggtcaagctccaggtcgaggaggtgcaccagctgtctcgcaaggctgagaccaagcttgcggaagcccagatcgaagaactgcggcagaaaactcaggaggagggagaagagcgggcagaatcagagcaggaggcttacctgagggaagac

SEQ ID NO: 32696 - DNA, 717 bp, Artificial Sequence
  Description of Artificial Sequence: Synthetic coding sequence
atggccgcgctgaagtcatggcttagccgcagcgtgacctcgttttttcggtacaggcagtgtctgtgcgttcctgtggtcgccaatttcaaaaagaggtgcttttccgaattgataaggccgtggcataagaccgtgactattggttttggtgttaccctctgtgccgtgccaatcgcacagaagtcggagcctcattccctgtcatcagaagcacttatgagaagagcagtttcccttgtgaccgactcaacttccaccttcctgtcccagaccacctacgctcttattgaagccattaccgaatacactaaggcagtctacacgctgacctcgctctaccgtcaatataccagccttctgggcaagatgaactcggaagaggaagatgaagtctggcaagtgataattggcgcaagagccgaaatgacctccaagcatcaagagtacttgaagttggagactacctggatgactgcagtcggtctttccgagatggccgcagaggcagcataccagaccggagcagatcaggcaagcatcaccgcgaggaaccacatccaactggtgaaacttcaggtggaggaagtgcaccaactgtcgagaaaggcagaaactaagctggccgaagcgcaaattgaagaactgcggcaaaagactcaagaggaaggggaggagagggccgaatcagaacaagaggcgtacctgcgggaagat

SEQ ID NO: 32697 - DNA, 717 bp, Artificial Sequence
  Description of Artificial Sequence: Synthetic coding sequence
atggctgccctgaaatcatggctgtcccgcagcgtgacctccttttttcgctacagacagtgcctgtgtgtccctgtggtggccaatttcaagaaaagatgcttttcggagcttatccgcccctggcataagactgtcaccataggctttggtgtgactctgtgtgccgtccctattgcacagaaatcggaaccacactctttgagctcggaagcgctcatgcgtagggctgtgtcgcttgtcaccgactcaacttccacctttttgtcacagactacttacgccttgatcgaagccatcaccgagtacaccaaggccgtctacaccctgacctcactctaccgccagtacactagcctgctgggaaaaatgaacagtgaggaagaggacgaagtctggcaagtgattattggagccagagcggaaatgacctcaaaacatcaggaataccttaagttggagacgacctggatgactgccgtggggctgtccgaaatggcagcagaagcagcttatcagaccggagcggatcaggcatcaatcactgcaagaaaccacattcaactcgtcaagctgcaagtggaagaggtgcatcagctgtcgcgcaaagccgagactaagctggcagaggcacaaatcgaggaactccgccaaaaaacccaagaagaaggtgaagaacgggcagaatcagagcaagaagcctacctgagagaagat

SEQ ID NO: 32698 - DNA, 717 bp, Artificial Sequence
  Description of Artificial Sequence: Synthetic coding sequence
atggccgctttgaagtcttggctcagccggtctgtaacctctttctttcgttaccgtcaatgcctgtgtgttcctgtggttgcgaattttaaaaagaggtgttttagcgaactcataaggccatggcataaaactgtcactataggttttggtgtgaccctgtgcgcagtgcccatcgcgcaaaagtctgagccccactccctttctagcgaggctttaatgcgaagagccgtttcgctggtgaccgacagtactagtacttttctctcccaaactacttacgcactgattgaagctatcactgagtacactaaagccgtatatacgttgactagcttatacagacagtacacatcactactgggtaagatgaattcagaagaagaggacgaggtctggcaggtcattataggcgctagagcggagatgacctccaaacaccaggagtacctgaagctcgaaaccacatggatgacagcagtcgggttatcagagatggccgcggaggcagcctatcagaccggcgcagatcaagccagcataaccgccagaaaccatatccaattggtgaaactgcaagtggaagaagtgcatcagctttctcgcaaggcggagactaagcttgccgaagcccagattgaagaactaaggcagaagacccaggaagagggcgaagaaagagccgagtccgaacaggaggcctacctcagggaggat

SEQ ID NO: 32699 - DNA, 717 bp, Artificial Sequence
  Description of Artificial Sequence: Synthetic coding sequence
atggcagccctgaaatcatggcttagcagatcggttacctccttcttccggtaccgtcagtgtctgtgtgtgccagtggtcgcgaacttcaagaagagatgtttcagcgagttgatccgtccctggcataaaactgtcaccatcggatttggtgtgaccctttgtgcagtgcctatcgcacagaagtcggagccgcactcgctctcgtcggaagccctgatgcgaagagccgtgtcccttgtgactgactcgacttcgaccttcctctcgcaaaccacctacgcgctgattgaggcgatcactgaatacaccaaggccgtctacactctcacctccctgtaccggcaatacacttcgctcctgggcaagatgaatagcgaagaagaggacgaggtgtggcaagtgattattggggcacgggctgagatgacctccaagcaccaagagtatctgaagttggagacgacctggatgactgcagtcggtcttagtgagatggcagccgaggcagcctaccaaactggtgcggatcaggcatctatcacggcccggaatcatattcagctggtgaagttgcaggttgaagaagtgcatcaactttcaaggaaggccgaaaccaaactggcagaagcgcagatcgaggagcttagacagaaaacccaggaagaaggtgaggaaagagcagagagcgaacaagaagcatacctcagggaggat

SEQ ID NO: 32700 - DNA, 717 bp, Artificial Sequence
  Description of Artificial Sequence: Synthetic coding sequence
atggcggccctgaaatcatggctctctcggtccgtcacctctttcttccggtacaggcagtgcctttgcgtcccggttgtagcgaacttcaagaagaggtgtttttcggagttgatcagaccatggcacaaaaccgtgacgatcggatttggcgtcaccttgtgcgccgtcccaatcgcccagaagtcggagccgcacagcctgtcgtcagaggcactgatgcgcagagcagtcagtttggtgaccgattccactagcaccttcctgtcgcagactacttacgctcttatcgaggccatcactgagtacaccaaggcagtgtacaccctgactagtctgtatagacaatatacttcactgcttggaaagatgaactccgaagaagaggacgaagtgtggcaggtgatcatcggggcgagagccgaaatgacctctaagcatcaggagtaccttaaactggaaaccacttggatgactgcagtcggactcagcgaaatggcggccgaggctgcataccaaacgggtgcagatcaggctagtattactgcccgaaatcacattcaactcgtgaagctgcaagtcgaagaagtgcatcaactctcgcgcaaggccgagacgaaactggcggaggcgcagatcgaagaactgcgtcaaaagacccaggaagagggagaggaacgggccgaatcagaacaagaagcctacctgcgggaggac

SEQ ID NO: 32701 - DNA, 717 bp, Artificial Sequence
  Description of Artificial Sequence: Synthetic coding sequence
atggctgcactgaagtcttggcttagccgcagtgtcactagcttcttcaggtataggcagtgtctgtgcgtgccagtggtagcaaatttcaaaaaaagatgtttttccgagctaatacggccctggcataagacggtgacgatcgggttcggagtcaccctatgtgcagttcccatagctcagaaaagcgaaccccactcgttgtcgtccgaagcattgatgcgcagagccgtttctctggtaacagacagcactagtacgtttctcagccagacaacctatgccctcatcgaggccataaccgagtacacaaaggcagtgtataccttgacaagcttgtatcgacagtatacctctctgctaggcaagatgaactcggaagaggaggacgaggtgtggcaagttatcattggcgcacgcgccgaaatgactagcaagcaccaggaatacctcaagctcgaaacgacttggatgaccgccgttggcctgtcagagatggctgccgaagcagcttaccagacaggggctgatcaagcatctatcaccgcccggaaccacattcagctcgtaaagttgcaggttgaggaggtgcaccagctctctcgcaaggccgagacaaaactcgccgaagcccagattgaagagctgagacagaaaactcaggaggaaggcgaagagcgcgctgaaagcgaacaagaggcctacctcagggaagac

SEQ ID NO: 32702 - DNA, 582 bp, Artificial Sequence
  Description of Artificial Sequence: Synthetic coding sequence
atgcacaagtggatcctcacatggattctgccaacactgctctatcgatcttgtttccacatcatctgcttagtaggcacgatttctctggcctgtaatgatatgacccccgagcagatggcgacgaatgtgaactgttcttccccagaacgccacactcggagctatgattacatggaaggaggggatatacgagtccgcaggcttttctgtcggacccagtggtatctgcgtatcgacaaacggggcaaggttaagggaacccaggagatgaagaacaactataatataatggaaatccgaactgtggcggttggcattgtggccattaaaggtgtagaatctgaattttatctggctatgaacaaagaggggaaactgtatgcgaaaaaggaatgtaatgaagattgtaattttaaggagcttattctcgaaaaccactataatacttatgcaagcgctaagtggactcacaacggaggagagatgttcgtagcattaaatcagaagggcatacccgtgagggggaaaaagacaaagaaggaacagaagactgcacattttctccccatggctataaca

SEQ ID NO: 32703 - DNA, 582 bp, Artificial Sequence
  Description of Artificial Sequence: Synthetic coding sequence
atgcacaagtggatcttgacctggatcctgcccactctgctctaccgctcatgtttccacatcatatgccttgtgggtaccatctcactggcctgcaatgatatgactcccgaacaaatggctactaatgtcaactgcagctcgccagaaaggcataccaggagctacgactacatggaaggaggggatattagagtgcgccggctcttctgtagaacccagtggtaccttcgcattgataagcgtggaaaagtcaagggcacccaggagatgaaaaacaactacaatatcatggaaattcgcaccgtggctgtgggaatcgtcgcaatcaaaggagtggagtcagagttctacctcgcgatgaacaaggagggtaagctgtacgccaagaaggaatgcaatgaggactgtaacttcaaggagttgatcttggaaaatcactacaacacttatgcaagcgccaagtggactcataatggtggagagatgtttgtggcacttaaccagaaggggatccctgtgcggggaaagaaaactaagaaagaacaaaagactgctcacttcctgccaatggctattact

SEQ ID NO: 32704 - DNA, 582 bp, Artificial Sequence
  Description of Artificial Sequence: Synthetic coding sequence
atgcacaagtggatattgacttggattcttccaacacttctgtacagatcctgctttcacattatttgcctcgttggcaccatttctcttgcctgcaatgatatgacacccgagcagatggccactaacgtgaattgttcatctccagaacgacataccagatcttacgactacatggaaggaggcgacatccgtgttcgacgcttgttttgtcgtacacaatggtaccttagaatagataagcgtggcaaggtcaagggcacacaggaaatgaagaacaattacaatatcatggagatccgaaccgtggcggtcggaattgtggccatcaaaggagttgaaagcgaattttaccttgccatgaacaaagaggggaagctgtacgccaagaaggagtgtaatgaagactgcaacttcaaagaactcattctggaaaaccactataatacatacgcctctgcgaagtggactcataacggtggcgagatgtttgttgcattaaatcagaaaggcattccagtgaggggcaaaaaaaccaagaaggaacagaaaacagcgcactttctgcccatggctattacg

SEQ ID NO: 32705 - DNA, 582 bp, Artificial Sequence
  Description of Artificial Sequence: Synthetic coding sequence
atgcacaagtggatcctgacctggatccttccaaccctgctctacagatcgtgctttcatatcatctgcctggtcggaactatttccctggcctgcaacgacatgacgccagaacagatggcaactaatgtcaactgctcgtcgccggaacgtcacacccggtcatacgattacatggaaggaggtgatatccgcgtccggcgcctgttttgcagaactcagtggtacctccggatcgataagcggggaaaggtgaaaggcacgcaggaaatgaagaacaactacaacatcatggaaatccggactgtggcggtgggtatcgtggccatcaagggagtggagtccgaattctacctggcaatgaacaaggaaggcaagctgtacgccaagaaggaatgcaacgaagattgtaacttcaaggagctgatccttgagaaccactacaacacctacgcgtccgcaaaatggacccacaacgggggtgagatgttcgtcgccctgaatcagaagggaattccggtgcggggcaagaaaaccaagaaggaacaaaagactgctcacttcctcccgatggccatcacg

SEQ ID NO: 32706 - DNA, 582 bp, Artificial Sequence
  Description of Artificial Sequence: Synthetic coding sequence
atgcataaatggattttaacatggattcttcccacactcctgtatcggagttgcttccacattatctgcctcgtgggtacgataagccttgcatgcaacgacatgacacccgaacagatggctacaaacgtgaactgctccagtcccgagcgccatacacgtagctacgattatatggaaggaggcgatatacgcgttaggagattgttttgtagaacacagtggtacttacgcatcgacaagaggggaaaggtaaaaggaacacaggagatgaaaaacaattataacatcatggagattcggaccgtggcagtcggtatagtggctataaagggcgtggagtccgagttttatttggcaatgaataaagagggcaaattgtacgccaagaaggaatgcaacgaagactgtaattttaaggagctaattctcgagaatcattataatacatacgctagcgcaaagtggacacataacggaggagaaatgttcgtggcactaaaccagaaagggattcctgtccgcggcaaaaaaactaaaaaagaacagaagaccgcacattttctccccatggcaattact

SEQ ID NO: 32707 - DNA, 582 bp, Artificial Sequence
  Description of Artificial Sequence: Synthetic coding sequence
atgcacaagtggatcctgacatggatacttccgactctgctgtaccggagctgcttccacattatctgcctggttgggaccatctccttggcctgcaatgatatgacacctgaacaaatggccacgaatgttaactgcagttccccagagcgccatactcgcagttatgactacatggagggtggagatatccgggtgagaagactattttgccgcacccaatggtatctgcgcatcgacaagcgtggcaaggtgaaaggcactcaagaaatgaagaacaattacaacatcatggagattcgtactgttgccgtgggtatcgttgcgattaaaggcgtcgaatccgagttttatcttgcaatgaataaggaaggtaagctctatgccaagaaggagtgcaatgaagactgcaatttcaaagagctaatcctcgaaaaccattacaatacctacgctagcgccaaatggactcataatgggggggagatgttcgtagccctcaaccagaaaggtatccctgtaagaggaaagaaaaccaaaaaggaacagaaaactgcacactttctccccatggccatcacc

SEQ ID NO: 32708 - DNA, 582 bp, Artificial Sequence
  Description of Artificial Sequence: Synthetic coding sequence
atgcataagtggatacttacatggattctgcccacactcctgtaccgaagctgcttccatataatttgtctggttggaaccatttcactcgcctgcaatgacatgacacctgaacagatggctacaaatgtgaattgcagcagcccggaaaggcatacccgttcttacgactacatggaaggcggagacattagggtgcgtcggcttttctgccgaacgcaatggtacctccggatcgacaaaagagggaaagtaaaaggaacacaggaaatgaaaaacaactacaatattatggaaatccgcacagttgccgtcggcatagttgcgataaagggcgtggagagcgaattctacttggctatgaacaaagaggggaaactgtacgctaagaaagagtgtaacgaggattgcaattttaaggagttgatcctcgagaatcactacaacacatatgccagcgcaaagtggacacacaacggcggcgagatgtttgtcgctcttaaccaaaagggcattccggtccgcgggaaaaagaccaagaaggaacagaagaccgcccattttctccctatggccataacc

SEQ ID NO: 32709 - DNA, 582 bp, Artificial Sequence
  Description of Artificial Sequence: Synthetic coding sequence
atgcacaagtggatattaacgtggattttgccaacactgttatatcgttcctgttttcacataatttgcctcgtaggtacaatttctctagcctgcaatgacatgaccccagagcagatggctacaaatgtgaattgctcatctccagaaagacatacccgtagctatgactacatggagggcggcgatatacgcgtaaggcggctgttttgtcgcacacagtggtacctcagaatcgacaagaggggaaaggtgaagggaacacaggaaatgaaaaataactacaacataatggaaattcgcaccgtcgctgttggtatcgtggctataaaaggagtggaaagcgagttttacctcgcaatgaataaagaggggaagctgtatgctaaaaaggagtgcaacgaggattgcaacttcaaggaactgattctggagaaccattataacacgtatgcgagcgcgaaatggacacacaatggcggagagatgttcgtagccttgaaccagaagggcatcccagtgcgcggtaaaaaaacgaagaaagagcagaaaacagcgcacttcctgccaatggctattaca

SEQ ID NO: 32710 - DNA, 582 bp, Artificial Sequence
  Description of Artificial Sequence: Synthetic coding sequence
atgcacaaatggatcctgacatggattctgccaacccttttgtatcgcagttgtttccatattatctgtttggtgggaactatcagtctggcctgtaacgacatgacacctgagcagatggccacaaacgtgaactgttcctcgccagaacgtcacacacgttcctacgactacatggagggcggtgatattcgcgtgaggcgcctgttttgcagaactcagtggtaccttcggatcgacaaacgcggaaaggtgaaggggacccaggagatgaagaataactacaacattatggaaattcgcactgtcgccgtcgggattgtcgcaatcaaaggagtggagtccgaattttaccttgcgatgaacaaagaaggcaaattatatgcaaaaaaagagtgtaatgaagactgcaactttaaagagcttattctggaaaaccactacaacacctacgcatctgcaaaatggacccacaatggcggcgagatgtttgtggcactcaatcagaaaggaatacccgtgagaggcaaaaaaactaaaaaggagcaaaagacagcacacttcctgccaatggccattacc

SEQ ID NO: 32711 - DNA, 582 bp, Artificial Sequence
  Description of Artificial Sequence: Synthetic coding sequence
atgcataaatggatactcacatggatcttacccaccctcctgtataggtcctgctttcatatcatatgtctggttggcaccatatcattggcctgcaatgatatgacgcccgagcagatggccactaacgttaactgcagttcaccggagcggcatacacgatcctacgactacatggagggtggcgacattcgcgtcaggcgactcttctgcagaacccagtggtatctgcgcatagacaagcggggaaaggttaagggaacccaggagatgaaaaataactataatattatggaaataagaaccgttgcagtcggcattgtagcaattaaaggcgtggaaagcgaattttacttagccatgaataaggaggggaaactgtacgccaaaaaggagtgcaacgaggattgtaactttaaagagctgattctagagaatcactacaatacatacgcaagtgcgaagtggacgcataacggcggcgagatgtttgtggcgttgaaccagaaaggtatcccagtgcggggtaaaaagactaaaaaggaacagaaaacagcacacttccttcctatggcaattact

SEQ ID NO: 32712 - DNA, 582 bp, Artificial Sequence
  Description of Artificial Sequence: Synthetic coding sequence
atgcataagtggatcttgacttggatattgcccacactgttgtatagatcttgctttcacatcatttgtctggttgggactatttcactcgcttgtaatgatatgaccccggagcagatggcaactaatgtgaactgttcttcgccagagcgacacacgcggagctacgattacatggaaggtggagacattcgtgtgaggcgcctgttctgtcggacccaatggtatcttagaattgacaaacgcgggaaggtgaagggaacgcaggaaatgaagaataactacaacatcatggaaatccggacggttgccgtgggcatcgtagccattaagggagtcgagtcagaattttacctggccatgaacaaggaaggcaaactctatgctaaaaaggaatgtaacgaggactgtaactttaaagagctcatcctggagaaccattacaatacctatgccagcgctaagtggacccacaacgggggggagatgttcgtggcccttaatcagaaagggatcccagtgcgaggtaagaagaccaaaaaggaacagaagactgcccacttcctcccaatggcaatcacg

SEQ ID NO: 32713 - DNA, 582 bp, Artificial Sequence
  Description of Artificial Sequence: Synthetic coding sequence
atgcacaagtggatcctcacctggatactgccgacactgctgtatcggtcgtgctttcatataatctgcctggtgggcacgatttcgttagcatgcaacgatatgaccccagagcagatggccaccaacgtaaactgctcaagcccggagaggcacactaggtcttacgattacatggagggcggtgacatccgggttcgacgcttgttctgccgtacccaatggtacctaagaatcgataaacgcggcaaggtgaagggtacccaagaaatgaagaacaattataatatcatggagattcgtacagtggctgtgggaatcgtggccattaagggggtggaatccgaattttacctggcgatgaacaaagaaggtaaattgtacgccaagaaagaatgcaacgaggactgcaatttcaaggagttgattctggagaatcactacaatacgtatgcaagtgcgaagtggactcacaacggaggcgaaatgttcgtggcacttaaccagaagggcatacctgtgcgagggaagaagacaaaaaaggagcagaagacagcgcatttcctgccgatggccataacg

SEQ ID NO: 32714 - DNA, 582 bp, Artificial Sequence
  Description of Artificial Sequence: Synthetic coding sequence
atgcacaagtggatcctaacctggattttacccactctcttgtatagatcatgcttccatattatttgtctggtgggtaccatctcgctagcttgtaacgatatgacacccgagcaaatggctacgaacgtaaactgtagttctcccgaacgccacacacgctcctacgattatatggagggcggcgatattagggtgaggaggctcttctgccggactcagtggtatctgaggatcgacaaacgcggaaaggtaaagggaactcaggaaatgaaaaacaattacaatatcatggaaatccgaactgtggccgttggcattgtggccattaagggagtggagtccgagttctacctggctatgaacaaggaagggaaactgtatgccaagaaagagtgcaacgaagactgcaactttaaggagctcattcttgagaaccactataacacatacgcatcagccaaatggactcataatgggggcgaaatgttcgtagccctcaaccaaaaggggatccccgttagaggaaagaaaaccaaaaaggagcagaagacagctcacttcttgcccatggctattaca

SEQ ID NO: 32715 - DNA, 582 bp, Artificial Sequence
  Description of Artificial Sequence: Synthetic coding sequence
atgcacaagtggatccttacctggatactgcctactcttctgtacaggtcgtgctttcacatcatttgccttgtcggaaccattagcctcgcgtgtaatgacatgaccccagagcagatggcaactaacgtcaactgtagctcccccgaaagacatactaggtcctatgattacatggaaggaggagacattcgagtcagacgacttttctgtcgaacccaatggtacctcagaatcgataaaagaggcaaggtgaagggaacgcaagagatgaagaacaattacaacataatggagattcgcaccgtggcagtggggatcgtggccataaagggtgtcgaatcggaattctacttggcaatgaacaaggaaggaaagctgtacgcaaaaaaggaatgtaatgaagattgtaactttaaggagcttattcttgaaaaccattacaatacgtacgcctccgccaaatggacccataacggaggtgagatgttcgtggcactcaaccaaaagggaattccagtgagaggtaagaaaactaagaaagaacaaaagactgcccactttcttcctatggccattacc

SEQ ID NO: 32716 - DNA, 582 bp, Artificial Sequence
  Description of Artificial Sequence: Synthetic coding sequence
atgcataaatggatccttacttggatcttgcctaccctgctgtaccgatcgtgttttcatatcatctgcttggttggtaccatctccttggcatgtaacgatatgactccagaacaaatggccactaatgtgaattgcagctcacccgaacgccacactagatcctacgattacatggagggaggggatattagagtgcggcgtttgttttgcagaactcagtggtacctgcgaatcgataaacggggtaaggtgaagggaacccaagagatgaagaacaattacaacattatggaaattcggactgtcgcagtgggcattgtggccattaaaggggtcgaatcggaattctaccttgcaatgaacaaggagggcaaactgtacgccaagaaggaatgtaatgaagattgtaactttaaagaactcatactggaaaaccactacaatacctacgcatcggcgaaatggacgcacaatggtggagagatgttcgtggcgcttaatcaaaagggtattccagttcgaggaaagaaaactaagaaagaacaaaagaccgcacattttcttccaatggcaataacc

SEQ ID NO: 32717 - DNA, 582 bp, Artificial Sequence
  Description of Artificial Sequence: Synthetic coding sequence
atgcacaaatggatcctcacctggattcttcccactctcctatataggtcgtgttttcatatcatctgcctggtcggtaccatcagtctggcttgtaatgatatgactccagaacagatggctacaaatgtgaactgttcgtctccagagcgccacacacggtcctacgattacatggagggcggtgatatcagagtcagacggcttttctgcagaacgcagtggtaccttaggatagacaagcgcggaaaagttaaaggcacacaagagatgaaaaacaattataatataatggagattcggactgtcgccgtaggcatcgtagcaatcaagggcgtggaatcagagttctacctggccatgaataaggagggtaaactctatgctaagaaagagtgcaacgaagactgcaactttaaggagctgatccttgagaaccattacaacacctatgcttctgccaagtggacacataatgggggggagatgtttgtcgccctcaaccagaaaggcatacctgtcaggggaaaaaagactaaaaaggagcagaagacagcacacttcctgccaatggcaatcact

SEQ ID NO: 32718 - DNA, 582 bp, Artificial Sequence
  Description of Artificial Sequence: Synthetic coding sequence
atgcataagtggatactgacttggattcttcctaccctgttgtaccgatcgtgtttccatatcatctgccttgtcggtaccatctccctggcatgtaatgatatgactccagagcaaatggccaccaacgtgaactgttcgtctccagagagacataccagatcatacgattacatggaaggcggtgacattcgtgtcagaaggctgttttgcaggacccagtggtaccttagaatcgataagagggggaaggtgaagggcactcaagagatgaagaacaactacaatatcatggaaattagaactgtggcggtgggcatcgtcgcaattaagggcgtggaatcggagttttaccttgcaatgaataaggaaggaaagctctacgccaagaaggaatgcaacgaagattgcaactttaaagaactgattcttgaaaaccattacaatacgtacgcctcggccaaatggacccacaatgggggagaaatgtttgtggccctcaatcagaaaggcatccccgtccgggggaagaaaactaagaaggaacaaaaaacggcacactttcttccaatggcaatcact

SEQ ID NO: 32719 - DNA, 582 bp, Artificial Sequence
  Description of Artificial Sequence: Synthetic coding sequence
atgcataagtggatcctcacttggatattgccgaccctgctttatcggtcgtgttttcatataatctgcctcgtcggtacgatcagccttgcttgtaacgatatgacccctgaacagatggcgacaaacgtaaactgctcctcacccgaaaggcacacacggtcatatgattatatggaaggtggggacatccgggtcaggagactcttctgcagaacacagtggtacctgaggatcgacaagaggggtaaggtgaaagggactcaggagatgaagaataactacaatatcatggagatcagaacagtcgctgttggaattgtcgcaattaaaggagtggagtctgagttttatctggctatgaataaagaaggcaagctgtacgccaagaaagaatgcaatgaggattgcaactttaaggagctgatcctagaaaaccattataatacttatgcttccgcaaagtggactcataatggtggagagatgttcgtggctcttaaccagaaggggattccagtcaggggcaagaagaccaagaaggagcaaaagacagcacactttctgcctatggcaattact

SEQ ID NO: 32720 - DNA, 582 bp, Artificial Sequence
  Description of Artificial Sequence: Synthetic coding sequence
atgcataaatggatcctgacctggatactgcccaccttgttatacaggagctgctttcacatcatctgcctggtgggcacaatttcacttgcctgcaatgatatgacaccagaacagatggcaacaaacgtgaattgcagcagtcccgagcggcacacaagatcgtacgactatatggaaggtggagacattagagtacgtcgcctgttctgtaggactcaatggtatctaaggatcgataagcgcggtaaagtaaagggcactcaggaaatgaagaacaattataacatcatggagatccggaccgtcgctgtcggcatcgtggcaattaaaggtgttgagagcgaattctacctggcaatgaacaaggaagggaaactctatgcaaagaaggagtgcaacgaggactgcaacttcaaagagctaatcctcgaaaaccactataacacctacgcgagcgccaagtggacccacaacggaggagaaatgttcgtcgctctgaatcagaagggcattcccgttagaggcaagaaaaccaaaaaggagcagaaaactgcacattttctgccaatggctatcaca

SEQ ID NO: 32721 - DNA, 582 bp, Artificial Sequence
  Description of Artificial Sequence: Synthetic coding sequence
atgcacaaatggatcctgacctggattctgcctaccctgctctatagatcgtgctttcatatcatctgtctggtggggaccattagcctcgcctgcaacgacatgacccctgagcagatggccaccaacgttaactgctcgagccccgaacgccacactcgcagctacgactacatggagggaggagatatccgggtgagacggctcttctgccggacccagtggtacctcagaatcgacaagagaggaaaggtcaagggaactcaggagatgaagaacaactacaatatcatggagatccgcaccgtggccgtcggaatcgtggccatcaagggagtagaatccgagttctacctcgccatgaacaaggagggtaagctgtacgccaaaaaggaatgcaatgaagattgtaatttcaaggaattgattcttgaaaatcactacaacacctatgcatcggctaagtggactcacaacggcggagaaatgtttgtggcgctcaaccaaaagggaatcccggtgagaggtaagaaaactaagaaagaacaaaaaaccgctcatttcctgccaatggctatcacc

SEQ ID NO: 32722 - DNA, 582 bp, Artificial Sequence
  Description of Artificial Sequence: Synthetic coding sequence
atgcacaagtggatcctgacctggattctgcccaccctcctctacaggtcttgtttccatattatctgccttgttgggaccatctccctggcctgtaatgatatgaccccagaacaaatggctaccaacgttaactgcagttcccctgagaggcatacccggtcctacgactatatggagggaggtgatatcagggtccgccgcctcttctgcaggacccaatggtatctgagaatagataagagaggcaaggtgaaaggaacgcaggagatgaagaataattataatattatggaaattagaacagttgcagtcgggatcgtggctattaaaggcgttgaaagtgagttttaccttgcgatgaacaaggagggaaagctgtacgccaaaaaagagtgtaatgaagattgtaacttcaaagaactgattttggagaatcactataatacttatgcctccgcaaagtggacccacaatggaggggagatgttcgtggcccttaaccagaagggcatacccgtgagaggcaagaagacaaaaaaagagcagaagactgcccatttcctccccatggccatcact

SEQ ID NO: 32723 - DNA, 582 bp, Artificial Sequence
  Description of Artificial Sequence: Synthetic coding sequence
atgcataagtggattttaacttggattttaccaacacttttatatagatcatgttttcatataatatgtttggtaggaacaatttcattagcatgtaatgatatgacgccagaacaaatggctacaaatgttaattgtagttcaccagaaagacacacaagatcatatgattatatggaaggtggagatattagggttcgtagattgttttgtagaacacaatggtatttaagaattgataaaagaggaaaagttaaaggaacacaagaaatgaaaaacaattataatattatggaaattaggacagtggcagtaggaatcgttgctattaagggagttgaatcagaattttatcttgctatgaataaggaaggaaaactttacgcaaaaaaggaatgtaatgaagactgtaattttaaagaattaattttagaaaatcattataatacttatgctagtgcaaaatggacacacaatggaggagaaatgtttgttgctcttaatcaaaaaggaattccagttagaggtaaaaagacaaagaaagaacaaaaaactgcacatttccttcctatggctataaca

SEQ ID NO: 32724 - DNA, 582 bp, Artificial Sequence
  Description of Artificial Sequence: Synthetic coding sequence
atgcacaaatggattctcacgtggattctgcccactcttctgtatcgctcgtgtttccatatcatctgcttggttggaacgatcagtctcgcctgtaatgatatgaccccggaacagatggctactaatgttaattgttccagccccgagagacacactcgcagttatgactatatggagggtggtgacatacgagtgcggagactgttttgtaggactcagtggtaccttaggattgataaacgcgggaaggtaaagggtacccaggaaatgaagaacaattacaacatcatggagatcaggaccgtcgcagtcggcattgtcgcaattaagggggttgagtctgagttctatctggccatgaataaggaaggcaagctctatgccaagaaggagtgcaatgaagattgcaattttaaagaactaattttagagaatcattataatacctacgcctcagcaaagtggacacataacggcggagaaatgtttgtcgccctcaatcagaaagggatccccgtgcgcgggaagaaaaccaagaaagaacagaagacagctcactttttacccatggccatcaca

SEQ ID NO: 32725 - DNA, 582 bp, Artificial Sequence
  Description of Artificial Sequence: Synthetic coding sequence
atgcacaaatggatcctgacctggatcttgccaactctgctgtaccggagctgctttcacatcatctgtttagtgggcaccatcagtctcgcttgtaacgatatgacgccagaacagatggcgaccaatgttaattgtagcagcccagaacgccatacccgcagctatgactacatggagggtggcgacattagagttcgccggcttttttgtcgtacacagtggtatctgagaattgacaaacgaggtaaagtgaaaggtacccaagagatgaagaataattataacatcatggaaattcgcacggtcgctgtggggatcgttgcaattaagggcgtggagagtgagttttacctagcgatgaataaggagggtaaactatacgcaaagaaagaatgcaatgaagattgcaactttaaggagctgatcctggagaaccactacaatacttacgcctccgctaagtggacgcataatggtggcgaaatgttcgtcgccctgaaccaaaagggtatccctgtgcgtggtaagaagaccaagaaggaacagaagaccgctcatttcttgccaatggccattacg

SEQ ID NO: 32726 - DNA, 582 bp, Artificial Sequence
  Description of Artificial Sequence: Synthetic coding sequence
atgcataaatggatcttgacctggattctgcctaccctgctgtacaggtcctgttttcatatcatatgcctcgtcggcactatttcactggcatgcaacgacatgacccccgaacaaatggccactaatgttaactgttccagtccagaaagacatacgcgctcgtacgattacatggagggtggagacatcagagtgcgtagactcttttgtaggactcaatggtatctgcgtatcgataagcggggaaaagtcaaggggactcaagagatgaagaataactacaacattatggaaattcggactgtggctgtcgggatcgtggccataaaaggcgttgaaagcgaattctacttggccatgaacaaggaaggcaaactttacgcaaagaaggaatgtaacgaagattgcaacttcaaggaactgattcttgagaatcattacaacacctacgcgtcggcaaagtggacccacaatgggggagagatgtttgtagcactcaaccagaagggtataccagtcagagggaagaaaactaagaaggagcagaaaacggcacacttccttcctatggctatcacc

SEQ ID NO: 32727 - DNA, 582 bp, Artificial Sequence
  Description of Artificial Sequence: Synthetic coding sequence
atgcacaagtggatcttgacttggatcttacccaccctcttatatcgatcatgtttccatatcatttgtttggtaggtaccatctctttagcctgcaacgatatgactccggaacaaatggcaactaatgttaattgtagttctccagaacgccatactcgatcatacgactatatggaaggaggagacattcgtgtccgtcgattgttctgcaggactcaatggtacctcagaattgataaacgtggcaaagtcaaaggaacccaagaaatgaaaaataattacaatattatggaaatccgtaccgttgccgtcggtatagtggcaatcaagggcgtcgagtcggagttctacttggcaatgaacaaagagggaaaactttacgctaagaaggaatgtaacgaggattgcaattttaaagagttgattctcgagaatcattataacacatacgccagtgctaagtggacacacaatggaggggagatgttcgtagctcttaatcaaaaagggatccctgtgagaggtaagaagaccaaaaaggagcagaaaacagctcacttcctgccaatggctataacg

SEQ ID NO: 32728 - DNA, 582 bp, Artificial Sequence
  Description of Artificial Sequence: Synthetic coding sequence
atgcacaagtggatcctcacttggatcctgccgactctcctgtaccgctcttgcttccatatcatttgcctcgtgggcactatctcactggcttgcaatgacatgactccagaacagatggcaaccaacgtgaattgttcctcgccagagcggcacacgcgaagctacgactacatggaaggcggagacatccgggtgagacgcctgttctgcaggacccaatggtacttgcgcatcgataaaagaggaaaagtgaaaggcacgcaggagatgaagaacaactacaatatcatggagattcggactgtcgcagtgggtatcgtggccatcaagggtgtggagtcagagttctacctggcaatgaataaggaaggaaaactgtacgccaagaaggagtgcaatgaggattgtaacttcaaagaactgatcttggagaaccactataacacttacgcgtcagcaaagtggactcacaatgggggtgagatgttcgtggccctcaaccagaagggcatcccggtgcggggaaagaaaactaagaaggagcaaaaaaccgcacactttctgcctatggctattacc

SEQ ID NO: 32729 - DNA, 582 bp, Artificial Sequence
  Description of Artificial Sequence: Synthetic coding sequence
atgcataagtggatacttacttggatccttccgaccctgctttaccgtagctgtttccacataatctgtcttgtcggtaccatcagcctcgcttgtaacgatatgacccctgaacagatggcaactaacgtaaactgctcgagcccagaacgacataccagatcgtatgactacatggaaggtggcgatattcgggtgcggaggttgttttgcagaacgcagtggtacctcagaattgataagcgaggaaaggtgaagggaactcaagaaatgaaaaacaactacaacattatggaaatcagaaccgtggcggtgggaatcgtggctattaagggcgtggagtctgagttctacctggctatgaataaggaggggaaactctacgccaagaaagagtgtaatgaggactgtaactttaaggagctgattctggaaaaccattacaatacgtacgccagcgcgaaatggacccacaatggtggagaaatgtttgtcgccctgaaccaaaagggtatacctgtcagaggaaaaaagactaagaaagagcaaaaaactgcacattttctccccatggcaattacg

SEQ ID NO: 32730 - DNA, 582 bp, Artificial Sequence
  Description of Artificial Sequence: Synthetic coding sequence
atgcacaagtggatcctgacttggattctcccaaccttgttgtacaggtcttgtttccacatcatctgcttggtaggcaccatcagccttgcctgcaatgacatgaccccggagcagatggcgacgaacgtgaattgctccagcccggaacgccacacccggtcctacgactacatggagggcggagatatccgcgtgaggcgcctcttctgtagaacccagtggtacctgagaattgataagcgcggaaaggtcaaaggaacgcaagagatgaagaacaactacaacatcatggaaattcgcaccgtggccgttggtatagtcgctatcaagggagtggaatcagagttctatctggcgatgaacaaagagggaaaactgtatgccaaaaaagaatgcaacgaggactgcaactttaaggagctgatcttggagaaccattacaatacttacgcatccgcgaagtggactcacaacggcggtgaaatgttcgtggcactgaatcaaaagggtatccccgtgcggggaaagaaaacgaaaaaggaacagaaaactgcgcatttcctcccgatggctatcact

SEQ ID NO: 32731 - DNA, 582 bp, Artificial Sequence
  Description of Artificial Sequence: Synthetic coding sequence
atgcacaagtggatcctcacttggattctcccaacactcctttaccgtagctgtttccatatcatttgcctcgtgggcaccatttccctcgcttgcaacgacatgacccccgagcagatggccacgaacgtgaactgctcgtcgcctgagcggcacacccgaagctacgactacatggagggaggcgatatccgtgtccgccgcctcttctgccggacgcaatggtacttgcgcattgacaaacgtggaaaggtcaagggcactcaggaaatgaagaataactacaacatcatggaaatccgcactgtggctgtcggcatcgtggcaataaagggcgtcgaatcggagttctacctcgcgatgaacaaagaaggtaagctgtacgctaagaaagagtgcaatgaggattgcaacttcaaggagttgattctggagaaccattataacacttatgcctctgccaagtggacgcacaatggcggcgaaatgttcgtggcccttaatcaaaagggtattcctgtcaggggcaagaagaccaaaaaggagcagaagacggcccacttccttcccatggctatcact

SEQ ID NO: 32732 - DNA, 582 bp, Artificial Sequence
  Description of Artificial Sequence: Synthetic coding sequence
atgcataagtggatcctaacctggatcctcccaacgttattgtatcggtcgtgctttcacatcatctgtttggtgggcaccatatcccttgcatgtaatgacatgacaccagagcagatggcgacaaacgtgaactgttcctctccagaacggcataccaggtcatacgattatatggagggaggagatatcagggtgcggcgtctgttctgtcggacacagtggtacctgaggattgataagcggggcaaggtgaagggcactcaggagatgaagaataactacaacattatggagataaggactgtggccgtgggaattgtggcgatcaagggtgtcgagtcggaattctatctggccatgaacaaggagggtaaactctatgccaagaaggagtgcaatgaggactgcaatttcaaggagttaatactggagaaccactataatacctatgcgagcgctaagtggacgcacaacggaggcgagatgtttgtcgccctgaatcagaaagggatccctgtgaggggaaagaagactaaaaaggaacaaaagaccgctcacttccttccaatggccatcacc

SEQ ID NO: 32733 - DNA, 582 bp, Artificial Sequence
  Description of Artificial Sequence: Synthetic coding sequence
atgcataaatggatactgacctggattcttccaactttgctctacaggtcgtgtttccacataatctgcctggtgggtactatcagtctcgcctgcaacgatatgacccccgaacaaatggccacgaacgtgaactgttcgtcccctgaaagacacacccggtcctacgactacatggagggaggagatattagagttaggcggctgttttgcaggactcagtggtacctgcgcattgataaacgaggtaaggtgaagggcactcaggagatgaagaacaattacaacatcatggaaatcaggacggtcgccgtgggaattgtggcaattaagggagtcgaatctgagttttatcttgctatgaacaaggagggcaaattgtacgcgaaaaaggaatgtaacgaggactgtaacttcaaggaactgatcctggaaaatcattacaacacctacgcatcagcaaagtggacccataatggcggtgaaatgtttgtagcacttaatcaaaagggaatcccagtccgcggcaagaaaaccaagaaagaacaaaagaccgcgcactttctcccgatggcgattacg

SEQ ID NO: 32734 - DNA, 582 bp, Artificial Sequence
  Description of Artificial Sequence: Synthetic coding sequence
atgcataagtggatcctcacctggattttgcccacactcctttaccgtagctgcttccatattatttgtctagtagggaccatctcccttgcgtgtaacgacatgacccctgagcagatggctactaatgttaactgttcttctcccgaacgccatacaaggagctacgactacatggagggaggtgatattagggtccggagattattctgtagaacacagtggtacctgcggattgataaaagaggaaaagtgaaggggacccaagaaatgaaaaataattataatatcatggagatccggactgtcgccgttgggatcgtcgcgattaagggggttgagagtgagttctatctcgccatgaataaggaagggaaactgtacgctaagaaggagtgtaacgaggactgcaattttaaggagctgatattggagaatcactacaatacctatgcctccgccaagtggactcataatggtggggagatgttcgtagctctcaatcagaaggggatccctgtgcgaggcaaaaagactaagaaggagcagaagacagcacattttctcccaatggctataact

SEQ ID NO: 32735 - DNA, 582 bp, Artificial Sequence
  Description of Artificial Sequence: Synthetic coding sequence
atgcataagtggatcctcacctggatcctgccgaccttgctgtaccgctcatgctttcacatcatttgtctcgtcgggaccatcagcttggcttgcaatgatatgactcctgaacagatggcgaccaacgtgaattgctcttcccctgaacggcatactcgctcatacgattacatggaaggaggagatattagagtccgccgcctgttctgtcggacccagtggtacctgagaatcgacaaacggggcaaggtgaagggaacgcaggagatgaagaacaactacaatatcatggagatcagaactgtggcggtggggattgtggccattaagggggtcgagtccgaattctacctcgctatgaataaagagggaaaactgtacgccaaaaaagaatgcaacgaggattgcaacttcaaggagctgatcttggaaaaccattacaatacctacgcttccgcaaagtggacgcataacggaggggaaatgtttgttgcattgaaccaaaagggcatcccggtgcgcgggaaaaagactaagaaagagcaaaagaccgcccactttcttccaatggccatcact

SEQ ID NO: 32736 - DNA, 582 bp, Artificial Sequence
  Description of Artificial Sequence: Synthetic coding sequence
atgcacaagtggattctgacgtggatcctgccaaccctgctgtatcgatcatgctttcacatcatatgcttggtggggaccatctcgttggcctgcaatgacatgaccccagagcaaatggccaccaatgtcaactgttcctcaccagagcgccatactcggtcctacgactacatggaaggaggagatatccgcgtgcggcgcctcttttgcagaactcagtggtacctcagaattgacaagagagggaaggtgaagggcacgcaggaaatgaagaacaactacaacatcatggaaatccggaccgtggccgtcggaatcgtggcaatcaagggtgtggaaagcgagttttacctggcgatgaataaagagggaaaattgtatgccaaaaaggagtgtaatgaggattgtaatttcaaggaactgatcctggaaaatcactacaacacctacgccagcgcgaaatggacccacaatggtggagagatgtttgtggccctgaaccagaaggggatccctgtccggggaaaaaagactaagaaggaacagaaaaccgcccatttcctgccgatggctatcact

SEQ ID NO: 32737 - DNA, 582 bp, Artificial Sequence
  Description of Artificial Sequence: Synthetic coding sequence
atgcacaaatggatactgacctggatacttcctaccctgctctataggagctgttttcatatcatctgtctggtcggcactatctctctcgcttgcaatgacatgacacctgaacaaatggccaccaacgttaactgcagtagtccggagaggcatacaagatcttacgactatatggaaggcggagatattcgagtgaggagactgttctgtaggacccaatggtacctgcgcattgacaaacgcggtaaagtgaaaggcacacaagaaatgaagaataactataacatcatggaaatcagaaccgtggcagttggaatcgtggccatcaagggagtggagagtgagttttatcttgccatgaacaaagagggaaaactttacgctaagaaggaatgtaacgaagactgtaactttaaggaactgatactggagaatcattataatacatacgcatccgctaaatggacacacaacggcggcgaaatgtttgtcgcactcaatcagaaagggatccccgtgcgcggaaagaaaacaaaaaaggagcagaaaacagcccatttcctgcccatggctatcact

SEQ ID NO: 32738 - DNA, 582 bp, Artificial Sequence
  Description of Artificial Sequence: Synthetic coding sequence
atgcataaatggatcctcacatggattctgccgacactgctgtatcgttcttgcttccacataatttgcctcgtggggaccatatccctggcatgtaacgacatgaccccagagcaaatggcaaccaatgtgaattgctcatcccccgagagacacacccgctcctacgattatatggagggcggagatattcgcgttcggcggttgttctgcagaacccagtggtacttaaggatagacaaacggggaaaagttaaaggaacccaggagatgaagaataactacaacattatggagataagaacagtagcagtggggattgtggccatcaaaggcgtggagagcgaattctacctcgccatgaacaaggaaggcaagctttacgccaagaaggagtgtaacgaggactgcaattttaaagagctcattctggagaaccattacaatacttacgcttctgccaagtggacacataacgggggagaaatgtttgtagcgctcaaccagaagggaatccccgtccgcggcaagaaaaccaagaaagagcagaagaccgcccacttccttcccatggccattacc

SEQ ID NO: 32739 - DNA, 582 bp, Artificial Sequence
  Description of Artificial Sequence: Synthetic coding sequence
atgcacaagtggatcctaacttggattctacccaccctgctatacagaagttgtttccacatcatctgcctcgtgggcacaattagtctcgcctgtaatgatatgacaccagagcaaatggctaccaatgttaattgttcaagccctgagcgtcatacgcggtcatatgactacatggaaggtggcgacatccgggtgcggagactgttctgtcggacgcagtggtatctccggatcgacaaaagaggaaaagtgaaggggacacaggaaatgaaaaacaattataacattatggagataagaacagttgcagtgggcattgtcgccatcaaaggtgtggagtcagagttttatctcgcaatgaacaaggaggggaagctctatgccaagaaggagtgtaatgaggattgcaactttaaagaattgattctggagaatcactacaatacatacgccagcgccaaatggactcataacggtggcgaaatgtttgtcgctctgaatcaaaaaggaatccccgtgagagggaagaagacaaaaaaagagcagaagacggcgcatttcttacccatggctataact

SEQ ID NO: 32740 - DNA, 582 bp, Artificial Sequence
  Description of Artificial Sequence: Synthetic coding sequence
atgcataaatggatcctgacttggatactgccgacgctgttgtatagatcctgtttccatattatctgcctggtcggtaccattagtttggcctgcaacgacatgacacctgagcagatggctacgaatgtgaactgctccagccctgagcgccacacccgctcctacgattacatggagggcggtgacattagagtgcgccgcttgttctgtaggacacagtggtacctcagaatagacaaaagaggcaaagtcaagggaacccaagaaatgaagaataactacaacataatggagattagaaccgttgctgtgggtattgtggcgatcaagggcgtggaaagtgagttttacctggcaatgaacaaggagggcaaactgtacgcaaaaaaagagtgtaatgaagattgcaacttcaaggagcttatactggaaaaccattacaacacttatgcaagtgctaagtggacgcacaatggtggtgaaatgtttgtggctctgaatcagaagggaattcccgtcaggggcaagaagacgaagaaggagcagaagaccgctcattttctccctatggccataacc

SEQ ID NO: 32741 - DNA, 582 bp, Artificial Sequence
  Description of Artificial Sequence: Synthetic coding sequence
atgcataagtggattctcacttggatcctcccgactctcctgtatcgctcctgtttccacattatctgccttgtgggcactatctcccttgcctgtaacgacatgaccccagagcaaatggccaccaatgtcaattgctcgtcaccggaaaggcatacgcgctcctacgactacatggagggcggagatatccgcgttcggcgcctcttctgccgcactcaatggtacttgaggattgacaagaggggaaaagtgaagggaacccaggagatgaagaacaactacaatatcatggagatccggaccgtggcggtgggaatcgtcgccattaagggagtcgagtcagaattctaccttgctatgaacaaagaaggcaagttgtacgcgaagaaggaatgcaacgaagattgcaacttcaaagaactgatactggaaaaccactacaacacctacgcttcggcgaagtggacccacaatgggggcgagatgttcgtggctctcaatcagaagggaatcccagtgcgggggaagaaaaccaaaaaggagcaaaaaactgcacactttttgccgatggcaatcacc

SEQ ID NO: 32742 - DNA, 582 bp, Artificial Sequence; identical to SEQ ID NO: 32702
  Description of Artificial Sequence: Synthetic coding sequence

SEQ ID NO: 32743 - DNA, 582 bp, Artificial Sequence
  Description of Artificial Sequence: Synthetic coding sequence
atgcataaatggatattaacgtggatattaccgacgctattatatcgttcgtgttttcatataatatgtttagtaggtacgatatcgctagcgtgtaatgatatgacgccggaacaaatggcgacgaatgttaattgttcgtcgccggaacgtcatacgcgatcgtatgattatatggaaggtggtgatatacgtgttcgacgattattttgtcgtacgcaatggtatttacgtatagataaacgaggtaaagttaaaggtacgcaagaaatgaaaaataattataatataatggaaatacgaacggtagcggttggtatagtagcgataaaaggtgtagaatcggaattttatttagcgatgaataaagaaggtaaattatatgcgaaaaaagaatgtaatgaagattgtaattttaaagaactaatattagaaaatcattataatacgtatgcgtcggcgaaatggacgcataatggtggtgaaatgtttgttgcgttaaatcaaaaaggtataccggtacgtggtaaaaaaacgaaaaaagaacaaaaaacggcgcattttctaccgatggcgataacg

SEQ ID NO: 32744 - DNA, 582 bp, Artificial Sequence
  Description of Artificial Sequence: Synthetic coding sequence
atgcacaaatggatcctaacctggatactccccaccctgctgtaccgttcttgctttcatattatttgtctggtgggcaccatatctctggcatgtaacgatatgacacctgaacagatggccactaacgtgaactgtagttcccccgaacggcacacccggtcttacgactacatggaaggcggtgatattcgggtcagaagactgttttgtcgcactcagtggtacctgcggattgataaaagaggaaaggtcaagggcacccaggaaatgaaaaacaactacaacataatggaaattcggaccgtcgcagtgggtatcgtggcaatcaaaggcgtggaatccgaattctatctggccatgaacaaagagggaaaactgtatgccaagaaggagtgcaacgaagattgcaacttcaaagaattaatcctcgagaatcattataacacttatgcctctgcaaaatggacccacaatggtggcgagatgttcgtcgctctgaatcagaaagggattccggttcggggaaagaaaactaaaaaggaacagaagactgcccatttcttacctatggctattacc

SEQ ID NO: 32745 - DNA, 582 bp, Artificial Sequence
  Description of Artificial Sequence: Synthetic coding sequence
atgcataagtggattctcacttggattctgcctaccctgctgtatcggtcgtgttttcacatcatatgtctggtgggcacgataagcctcgcctgtaacgatatgactccagaacagatggcaactaacgtgaactgcagctctcccgagcgccacacgagatcctacgactacatggaaggcggggacattagggttaggagacttttctgccgaacccagtggtatctcagaattgacaaaagagggaaggtgaaaggcactcaggagatgaagaacaattacaacatcatggagattcgtactgtcgccgtgggaatcgtcgcgattaagggtgtagagtcagaattctacctggcaatgaataaggaaggaaagctgtatgcaaaaaaggaatgtaatgaggattgcaatttcaaggaactgattcttgaaaaccattacaacacttatgcatcggctaagtggacccataacggtggagaaatgtttgtggcattgaatcaaaaaggcatcccagtgcgtggcaagaaaactaagaaggaacaaaagaccgcacactttcttccaatggcaattacc

SEQ ID NO: 32746 - DNA, 582 bp, Artificial Sequence
  Description of Artificial Sequence: Synthetic coding sequence
atgcataaatggattcttacctggatcttaccaacgctcctttatcgcagttgctttcacatcatctgcctagtgggaactattagcttggcttgtaacgatatgacccccgaacagatggctaccaacgtaaattgctcctcccctgagaggcacacccgatcctacgattatatggagggtggagatattcgggttaggcggctgttctgccgcacgcagtggtatcttcggattgacaagcgaggcaaagtgaaagggacacaggagatgaaaaataattataacatcatggagatccgaaccgtggcagtgggaattgttgcaataaagggggttgaatcggagttctacctagcgatgaataaggaggggaagttatacgcgaaaaaagagtgcaacgaggactgcaacttcaaagagctcatcctggagaatcactacaacacgtacgcctcagcaaaatggacgcacaatggaggagaaatgtttgtggccctcaaccagaagggcattcctgtgcggggcaaaaaaactaagaaggagcagaaaacagcccattttcttccaatggctatcaca

SEQ ID NO: 32747 - DNA, 582 bp, Artificial Sequence
  Description of Artificial Sequence: Synthetic coding sequence
atgcacaagtggatcctgacatggatcttgcccaccctgctctataggagttgttttcacattatctgtttggtaggcacgatctccctggcctgtaatgatatgacaccagagcagatggccacaaatgtcaattgcagcagtccagagaggcacacaagatcttatgactatatggaagggggcgatataagggtgcgacggctgttctgccggacacagtggtatctgaggattgacaagcgcggcaaagtcaagggaacccaagagatgaaaaataattacaatattatggaaatcaggacagtagccgtggggatagtggcgattaagggtgtggaaagtgagttctacttggctatgaacaaggagggcaaactgtacgctaagaaagagtgcaatgaggactgcaatttcaaagaactgatcctggagaaccactacaacacttatgcgagtgcaaaatggacacacaacggtggagagatgtttgtagctctgaatcagaagggcatcccagtgcgggggaagaagactaagaaggagcagaaaactgcacactttctgcccatggccatcacc

SEQ ID NO: 32748 - DNA, 582 bp, Artificial Sequence
  Description of Artificial Sequence: Synthetic coding sequence
atgcataaatggatcctgacttggatccttcccactctcctatatcggtcttgttttcatataatctgccttgtgggaacaatttctctcgcgtgtaatgatatgactcctgagcagatggctactaatgtcaattgctcctctcccgaacggcatacaaggtcgtacgactatatggaagggggggacatcagagtccggcgactgttctgtaggacacagtggtacctccgaatagataaacgggggaaggttaaaggaactcaggaaatgaaaaataattataacatcatggaaatacgaactgtggccgtgggaatcgtggctatcaaaggggttgaatctgaattctacctagccatgaataaagagggaaaattgtatgcaaaaaaagaatgcaacgaagattgcaatttcaaagagctaatcctagagaatcattataatacttatgcctcagcaaagtggacacataatggaggagaaatgttcgtcgcactgaatcagaaagggataccagtacgggggaaaaaaacaaaaaaagagcaaaaaacagcacactttctgcccatggcaataact

SEQ ID NO: 32749 - DNA, 582 bp, Artificial Sequence
  Description of Artificial Sequence: Synthetic coding sequence
atgcataaatggatcctcacctggattctcccgaccctgctttacaggtcctgttttcacattatctgcctggtgggaactatctccctggcatgcaatgatatgaccccggagcaaatggcaacgaacgtcaattgttcatcgcctgagaggcataccagatcgtacgactacatggaagggggcgatattcgcgtcagacgcttgttttgtcgcactcagtggtacctgcgcattgacaagagaggaaaagtcaagggtacccaggaaatgaagaataactacaacatcatggaaattagaacggtcgcggtgggaatagtggccatcaagggcgtggagagcgaattctacctggcaatgaacaaggagggtaaactttacgcaaagaaagagtgtaatgaggattgcaactttaaggaactgattctggaaaaccattacaatacttacgcaagcgctaaatggacccacaatggaggtgaaatgtttgtcgctttgaaccaaaagggaataccagtccgcggtaagaaaactaagaaggaacaaaagactgcacactttctccctatggccattact

SEQ ID NO: 32750 - DNA, 582 bp, Artificial Sequence
  Description of Artificial Sequence: Synthetic coding sequence
atgcacaagtggatcctgacttggattctcccaaccctgctctacaggagctgttttcatataatctgtcttgttggaacgattagcctggcgtgcaatgatatgacaccggaacaaatggctactaatgtcaactgctcttcccccgagcggcacaccagatcatacgattatatggaagggggagacatccgagtacggcgtctcttttgccggactcagtggtacctgagaattgacaagcgcggcaaggtgaaaggcactcaggagatgaaaaacaactacaacattatggagattcgcaccgttgccgtgggcattgttgcaattaaaggagtggagtccgagttctatctagccatgaataaagagggcaaactgtatgctaaaaaagaatgtaacgaagactgcaacttcaaagaacttattctagagaatcactacaatacgtacgcctccgccaaatggacccacaacggaggtgaaatgttcgttgctctgaatcagaaggggattccggtgcggggaaaaaagactaaaaaggaacagaaaacagctcacttcctgcccatggccatcact

SEQ ID NO: 32751 - DNA, 582 bp, Artificial Sequence
  Description of Artificial Sequence: Synthetic coding sequence
atgcataaatggatccttacatggattctgcctacacttctgtacaggtcatgcttccatattatttgtttggtaggaactatttctctggcctgcaatgatatgaccccagagcaaatggctactaatgtgaattgctcgtcaccagagcggcataccagaagctacgattacatggaggggggggacattcgggtgcgccggctgttctgtagaacccagtggtacctgcggatcgacaagcggggcaaggtgaaaggcacacaagaaatgaaaaacaactataacatcatggaaatccgtacagtcgccgttggtattgtggcgatcaagggtgtcgagtcagagttctatctcgcaatgaataaggagggcaaattgtacgcaaaaaaggagtgtaatgaggattgtaattttaaggaactgatactcgagaatcattataacacctatgcctcagcgaaatggacccacaacggcggcgaaatgtttgttgccctgaaccagaaaggcattccggttcgcgggaagaagacaaaaaaggagcagaaaaccgcccatttcctccctatggcgattaca

SEQ ID NO: 32752 - DNA, 582 bp, Artificial Sequence
  Description of Artificial Sequence: Synthetic coding sequence
atgcataaatggatactgacctggatcctcccaacccttctttacagatcatgttttcacatcatctgccttgttggaactatctccttggcctgtaatgatatgacgccggaacaaatggcaactaacgtgaactgttcatctccagagcgacatactagaagctacgactacatggaagggggtgatattcgggtgcgccgtttgttttgcagaacccaatggtaccttcgcattgataaaaggggaaaagtgaagggtacccaagagatgaagaataactacaacattatggagattaggaccgtggcagtcgggattgtggctatcaagggagtggaatcggagttctacctcgccatgaacaaagaaggtaagctgtacgcgaagaaggaatgtaatgaggactgtaactttaaggagctgattctcgaaaaccactataacacttatgcatccgcaaagtggacgcataatggcggcgaaatgtttgttgcgctgaaccagaagggaataccggtccgtggcaaaaagacgaagaaggaacagaaaacggcacacttccttcctatggcaattact

SEQ ID NO: 32753 - DNA, 582 bp, Artificial Sequence
  Description of Artificial Sequence: Synthetic coding sequence
atgcacaaatggatcctgacctggatcctgcctactctgctctacagatcatgcttccacatcatttgcctcgtcggaactatctccctcgcctgtaatgacatgacccctgagcagatggctactaacgtcaattgctcgtcccccgaacgccataccagatcatacgattacatggaaggaggagatatccgggtgcgccggctcttctgccgaactcaatggtacctgcgcatcgataagagaggaaaggttaagggcactcaggaaatgaagaacaactacaacatcatggaaatccgcactgtggcagtgggtatcgtggcgattaagggcgtggagagcgaattctacctggccatgaacaaggagggaaagctgtacgcaaagaaggaatgcaacgaggactgcaatttcaaggaactgatcctggaaaatcactataacacctacgcaagcgccaaatggacgcataacggaggagagatgtttgtggccctgaaccagaaggggatcccggtgagaggcaagaaaactaagaaagagcagaaaactgcccatttcctgccgatggccatcacg

SEQ ID NO: 32754 - DNA, 582 bp, Artificial Sequence
  Description of Artificial Sequence: Synthetic coding sequence
atgcataagtggatactgacttggatccttccaactcttctctatagatcgtgctttcatattatttgtctggttggcactatttctttggcctgtaacgacatgactccggagcagatggctaccaacgtaaactgcagcagcccagaaaggcacacacggtcttacgactacatggaggggggcgatattcgtgtccgcagattattttgcaggacacagtggtacctgagaattgataaacgcgggaaggtgaagggtactcaggagatgaagaataactacaacataatggaaattagaacggtggcggtcggcatcgtggcaattaaaggagtggaatccgagttttacctggctatgaacaaagagggaaagctttacgccaagaaggagtgtaacgaggattgcaactttaaggaactgatcctcgagaatcactacaatacctatgcatccgcaaaatggacacacaatggtggggagatgtttgtggcactcaaccagaagggtattcctgtgagggggaaaaaaacaaagaaggagcagaagacagctcattttcttcccatggctatcacc

SEQ ID NO: 32755 - DNA, 582 bp, Artificial Sequence
  Description of Artificial Sequence: Synthetic coding sequence
atgcacaaatggattctgacctggatccttccaacgttgctctaccgctcttgttttcacattatctgtctcgtcggcacaatttctctggcatgcaacgacatgactcccgagcagatggctaccaatgtcaactgtagttctcctgagcgacatacccggtcttatgactatatggaaggcggagatataagggtgagaaggctgttttgtagaactcagtggtatctgagaatagataagcggggaaaagtgaaggggactcaggaaatgaaaaataattataacatcatggagatccggactgtcgcagtcgggattgttgcgatcaagggcgtggagagcgaattctatctggccatgaacaaagagggcaagctttacgccaaaaaagaatgtaatgaagattgcaactttaaagaactgattctggaaaatcactacaatacatacgcttccgctaaatggactcataatggtggtgagatgtttgtggcactgaatcagaaaggaatccccgtgagggggaaaaagaccaagaaagagcaaaaaacagctcactttctgcccatggctataacc

SEQ ID NO: 32756 - DNA, 582 bp, Artificial Sequence
  Description of Artificial Sequence: Synthetic coding sequence
atgcataaatggattcttacttggattttgccgactctcctgtaccgttcatgtttccatatcatctgcctggtggggactatcagcctggcgtgcaatgacatgaccccagaacaaatggccaccaacgtgaattgctccagccccgagcgccacaccagatcgtatgactacatggaggggggagacatccgagtgcggcgcctgttctgtcgcacgcagtggtacctccggattgataagcggggaaaggtgaaaggaacccaggagatgaagaataactacaatatcatggaaatccgtactgtcgccgtcggcatcgtggctatcaagggtgtggaaagcgaattctatctggccatgaataaggagggaaagctctacgccaaaaaagagtgcaacgaagattgtaactttaaagagctgatcctcgagaatcactacaacacctacgcctccgcaaagtggacccataacggaggcgaaatgtttgtggcgttgaaccagaagggaatcccagtgaggggcaaaaagactaagaaggaacaaaaaaccgctcacttcctgccgatggctatcact

SEQ ID NO: 32757 - DNA, 582 bp, Artificial Sequence
  Description of Artificial Sequence: Synthetic coding sequence
atgcacaagtggatactcacttggattcttcctacacttctgtatcgctcttgtttccatatcatctgccttgttgggactatctcgcttgcttgcaatgatatgacaccagagcagatggctactaatgtaaattgcagttctccagaaagacacacacgctcatatgattacatggaaggaggagatatccgagttaggagactcttttgcagaactcaatggtatctccgtatagataaacggggaaaagtaaaagggacacaagaaatgaaaaataactataatataatggaaattcgtactgtggctgtaggaatagttgccatcaaaggggttgaatctgagttctatcttgccatgaataaagaagggaaactctatgccaaaaaggaatgcaatgaagattgtaacttcaaagaactgatactggaaaatcactataacacttacgcttctgctaaatggactcataacgggggggaaatgttcgttgcactaaaccagaaaggaatacccgtgcgggggaaaaaaactaaaaaagaacagaaaactgctcacttcctgcctatggccattaca

SEQ ID NO: 32758 - DNA, 582 bp, Artificial Sequence
  Description of Artificial Sequence: Synthetic coding sequence
atgcataagtggattcttacatggattctcccaacccttctgtacaggtcatgttttcacatcatttgtctggtcggcaccatttccttggcctgcaatgatatgactccagagcaaatggccacaaacgtaaattgcagtagtcctgagaggcacacaagatcctatgactacatggagggtggtgatattagagtgaggagactattttgcaggacccagtggtatctgagaatcgataagcgggggaaagtgaagggcacccaggagatgaagaacaattacaacatcatggagattagaactgtagccgtgggcatagtggcaattaagggtgtcgaaagcgagttttatcttgctatgaataaagaaggtaagctctacgctaagaaagaatgcaatgaggactgcaattttaaagagctgatactagaaaaccattacaatacttatgcaagtgcaaagtggacccacaacggcggcgagatgttcgtagccctgaaccagaaagggatcccagtacggggcaagaagactaaaaaagaacagaagacggcccattttcttcctatggccatcacc

SEQ ID NO: 32759 - DNA, 582 bp, Artificial Sequence
  Description of Artificial Sequence: Synthetic coding sequence
atgcataagtggattctgacctggattctgcctactcttctttaccggtcatgttttcatatcatctgtcttgtgggaactatcagcttggcgtgtaacgatatgactccggaacaaatggccaccaacgtcaactgttcttcgccagagcggcatactcggagctacgactacatggagggcggtgatatccgcgtgagacgactgttctgccgtacccagtggtaccttcggatcgataagcggggtaaagtgaaggggacccaagaaatgaagaacaattacaacataatggagatcagaacggtggccgtcgggatcgtggccatcaagggagtggaatcggagttctacctggcaatgaataaagaagggaaactttacgcaaagaaggagtgtaatgaagattgcaactttaaggaactcatccttgaaaatcactacaatacttacgcctccgctaagtggacccataatggtggtgaaatgtttgtcgcactgaaccagaaaggtattcccgtgagaggcaaaaagaccaaaaaggaacagaaaaccgcacactttctgccgatggctattacc

SEQ ID NO: 32760 - DNA, 582 bp, Artificial Sequence
  Description of Artificial Sequence: Synthetic coding sequence
atgcacaaatggatacttacttggattcttccgaccctcctctaccggagctgcttccatatcatttgtttggtggggactatttcgcttgcatgtaacgacatgacccctgagcagatggccactaacgtgaactgttcatccccagaacgacacaccagatcgtacgattacatggaaggcggcgatatccgtgtcagacgacttttctgtagaacccagtggtacctgcgtatagacaagcggggtaaggtcaagggcactcaagagatgaagaacaactacaacattatggaaatcaggactgtcgccgtcggtattgtggcgatcaagggagtggaatcggagttttacctcgcgatgaacaaggagggaaagctgtacgcaaagaaagagtgcaacgaagattgtaactttaaggaactcatacttgagaatcattacaacacgtatgcatcagcaaagtggactcataatggaggtgaaatgtttgtggccctgaatcaaaaaggcatcccagtgcgtggcaaaaagaccaaaaaggagcaaaagaccgcacactttttgcctatggccattact

SEQ ID NO: 32761 - DNA, 582 bp, Artificial Sequence
  Description of Artificial Sequence: Synthetic coding sequence
atgcataaatggattctgacttggatccttccaactctcctgtacagatcgtgctttcacattatctgtctcgtgggtactatcagcctggcttgtaatgatatgaccccagaacaaatggccactaatgtgaattgtagctcgccagaaagacacactcgatcctacgattacatggagggtggagatattagggttcggcgcctgttctgtcgcactcagtggtaccttcgaattgataaacggggaaaggttaagggcacccaagagatgaaaaacaactacaatatcatggaaatacgaacggtcgccgtgggaattgtggcaatcaaaggtgtggagtccgagttctacttggccatgaataaggaaggaaaactttacgccaagaaagagtgtaacgaagattgtaatttcaaggaactgatacttgaaaaccattacaatacttatgcttcggcaaagtggacccataacggcggcgaaatgtttgtcgcgcttaaccagaaagggattccagtgaggggtaaaaagaccaagaaagaacaaaagacggcgcatttcttgcctatggcaattacc

SEQ ID NO: 32762 - DNA, 582 bp, Artificial Sequence
  Description of Artificial Sequence: Synthetic coding sequence
atgcataaatggatcttgacatggattttaccgaccttgctctatagaagttgttttcatatcatctgccttgtgggaacaatctcgttggcatgcaatgacatgacaccagagcaaatggccaccaacgttaactgctccagccctgaacgtcatacgagaagctacgattatatggaaggtggcgatattagagttcggagattattttgtcgtacgcagtggtatttgcgaatcgacaaacgaggtaaagtgaaaggtactcaagaaatgaaaaataattataatattatggaaatccggacagtagcggtaggaatcgtggctattaaaggagtcgaatcagaattttatctcgctatgaataaagaaggtaaattgtacgctaaaaaagagtgtaatgaggattgcaacttcaaagagttgattcttgaaaatcactacaatacatatgccagtgccaagtggacgcataatggaggtgagatgtttgtggcgcttaatcaaaaaggaattcctgtgaggggaaaaaaaacaaaaaaggaacagaaaacagcccatttcttgccgatggcgatcaca

SEQ ID NO: 32763 - DNA, 582 bp, Artificial Sequence
  Description of Artificial Sequence: Synthetic coding sequence
atgcacaagtggattctcacctggatcctgccgacccttctctacaggtcgtgctttcatatcatctgcttggtgggaaccatctcactcgcatgcaacgatatgactccggagcaaatggcgactaacgttaactgttcatccccggagcggcatacccgctcctacgactacatggagggcggagacatcagggtccgccggttgttctgcaggactcagtggtatctgagaattgataagagggggaaggtgaaaggcacccaggaaatgaagaacaattacaatatcatggaaatccggactgtggccgttggaatcgtcgcaatcaagggagtggaatccgaattctacctcgctatgaataaggaaggaaagctgtacgccaagaaggaatgtaatgaggattgtaacttcaaggagctcattttggaaaatcattacaacacctacgcctcggcgaagtggacgcataatggcggcgagatgttcgtggcgctcaaccaaaagggaattccagtgagagggaaaaagaccaagaaagagcagaaaaccgcccacttcctcccgatggccatcact

SEQ ID NO: 32764 - DNA, 582 bp, Artificial Sequence
  Description of Artificial Sequence: Synthetic coding sequence
atgcacaagtggatcctcacctggatcctccccaccctgctctacagatcatgctttcacattatctgtcttgtcggaacgatctcactggcttgtaatgatatgacgcctgaacagatggccactaacgtcaactgctcgtctcccgaaaggcacactaggagctacgattacatggagggaggagacatccgggtccgccgcctgttttgccggactcagtggtaccttcgcatcgacaaacgcggcaaggtgaaggggacccaggagatgaagaacaactacaatatcatggaaatccgtactgtggcagtcggaatcgtggctatcaagggggtggagagcgaattctacctggccatgaacaaggagggcaagctgtacgcaaagaaggagtgcaacgaggattgcaatttcaaagaacttattctcgaaaaccattacaacacctatgcgtctgcaaaatggactcataatggaggcgagatgttcgtggccctgaatcagaagggcatcccggtgagaggcaagaaaacgaaaaaagagcaaaagaccgctcacttcctgccgatggcgatcacc

SEQ ID NO: 32765 - DNA, 582 bp, Artificial Sequence
  Description of Artificial Sequence: Synthetic coding sequence
atgcacaaatggatcctgacgtggatcttgccaacgctcctttaccggagctgttttcacattatctgcctcgtgggcaccatctcactcgcctgcaacgacatgacccccgaacaaatggcgactaatgtgaattgctcgagcccagaaaggcacactcgatcgtacgactacatggagggtggagacattagagtgcggcgcctgttttgtagaacccagtggtatcttcggatcgacaagcgaggaaaggttaagggtacccaggaaatgaagaacaattacaacataatggagattaggacggtggcagtgggtatcgtcgcaatcaagggcgtcgaatccgaattctacctggccatgaataaggaaggaaagctgtacgcaaagaaggaatgtaatgaggactgcaacttcaaagaacttattcttgaaaaccattacaacacttatgcgtcggcaaaatggacccacaacggtggtgagatgttcgtggccttgaaccaaaaaggaattcctgtgcgtggaaagaaaaccaagaaggaacagaaaaccgcacacttccttccaatggcaattacc

SEQ ID NO: 32766 - DNA, 582 bp, Artificial Sequence
  Description of Artificial Sequence: Synthetic coding sequence
atgcacaaatggatcctcacgtggatcctgcctaccctcctgtatcggtcctgctttcacatcatttgccttgtaggcactatctcgcttgcttgtaacgatatgacccctgaacagatggccactaacgtaaactgttcgagccctgagcgccacacccgttcttacgactatatggagggaggtgatatccgagtccgtagacttttctgccgcacccaatggtatctaagaatcgacaagcgtggtaaggtaaagggaacgcaagaaatgaaaaacaattacaacatcatggagatccggactgtggccgtcggcattgttgctatcaagggcgtagaatcggagttctaccttgctatgaataaggaaggtaaactatatgctaagaaggaatgcaacgaggattgcaacttcaaggaacttattttggaaaaccattataacacgtatgcatccgcgaagtggacccacaacgggggagagatgttcgttgctttgaaccaaaagggtatccccgtgcgaggcaagaagacaaaaaaagaacagaaaacggctcactttctacccatggccattacc

SEQ ID NO: 32767 - DNA, 582 bp, Artificial Sequence
  Description of Artificial Sequence: Synthetic coding sequence
atgcataagtggatcctcacctggatcctgcccacattgctctacaggtcatgttttcatatcatctgcctggtggggaccatttccttggcttgcaatgacatgacacccgagcaaatggctacaaatgtgaactgcagcagccccgagcgacatacgcgaagctacgattacatggagggcggagatatcagggttagacggcttttttgtaggactcagtggtacctcaggatcgacaaacgaggcaaggtcaagggaacacaggagatgaaaaacaattataacatcatggaaattcgaaccgttgctgtgggcatagtagctataaagggcgtggagagcgaattttatctggccatgaacaaggaaggtaaactctacgccaagaaggagtgcaacgaggattgcaattttaaagaactgattctggagaaccactataatacctatgcgagtgctaaatggacccacaacggcggagagatgtttgtggcacttaaccaaaaagggatacccgtccgcggcaaaaaaaccaagaaagaacaaaaaacggcccattttttgcccatggccatcact

SEQ ID NO: 32768 - DNA, 582 bp, Artificial Sequence
  Description of Artificial Sequence: Synthetic coding sequence
atgcataaatggattttaacctggattcttcctacattgctctacaggtcgtgtttccatatcatatgcttagtcggtaccatttcattggcctgcaatgacatgacccctgaacagatggctacaaacgttaattgcagttcccctgaacgacataccaggtcctacgactacatggaagggggtgatattagagtgagaaggctcttctgtaggacccaatggtatctcagaatagataagcgaggtaaagtaaaagggacacaggaaatgaagaataactacaacattatggagatcaggacagttgcggtgggaattgtggccataaaaggagtggagtccgaattttatttagctatgaacaaggaaggtaagttgtatgctaagaaagaatgcaatgaggactgtaattttaaggagcttattctagagaatcattacaacacttatgcaagcgctaagtggactcataatgggggagaaatgtttgtggcattgaatcagaagggaattcccgttaggggtaagaaaacaaaaaaggagcagaaaactgcacattttctaccgatggcaattacg

SEQ ID NO: 32769 - DNA, 582 bp, Artificial Sequence
  Description of Artificial Sequence: Synthetic coding sequence
atgcacaagtggatactgacctggatactcccaaccttgttatatcgatcctgctttcatatcatttgtttggttgggactatatcactcgcctgtaatgacatgaccccagagcagatggccaccaatgtaaactgtagttcgcccgagcggcataccagatcttacgattatatggaaggcggagatatcagagtcagacgtttgttctgccggactcaatggtatctgcgtatcgacaagaggggaaaggtaaagggaacccaggagatgaaaaacaactataatattatggagatacgcactgtagcagttggcatcgttgctattaagggagttgaaagcgagttttacttagctatgaacaaggagggaaaactatatgctaaaaaagaatgcaacgaggattgtaattttaaagaactgatacttgagaatcactataatacctacgcatcagccaagtggacacataacggtggagagatgtttgtggccctgaaccagaaggggatccccgtacgcggaaagaaaactaaaaaggagcagaaaacagcacacttcctgcccatggcgattaca

SEQ ID NO: 32770 - DNA, 582 bp, Artificial Sequence
  Description of Artificial Sequence: Synthetic coding sequence
atgcacaagtggattctaacctggatactgcctacgctactgtacagaagctgcttccatatcatatgcttggtgggcactatcagtctagcatgtaatgatatgacccccgagcagatggccactaacgtcaactgcagttcccccgagaggcatacccgatcctacgactatatggaaggcggtgatatcagagtgcgcaggttgttctgcaggacccagtggtatctgcgaatcgacaaacggggaaaggtgaagggtacccaggagatgaagaacaattataacataatggaaatcaggacggttgctgttggtatcgtcgccatcaagggcgtagaaagcgaattctacttggctatgaataaggagggtaagctgtacgcgaagaaagaatgtaacgaggactgcaacttcaaggagctcattctggaaaatcactataacacatatgcttcggccaaatggacccataacggaggtgagatgtttgtagcactaaatcaaaaaggcatccctgtgcggggaaaaaaaaccaagaaggaacagaagacagcacactttcttccaatggcaattacc

SEQ ID NO: 32771 - DNA, 582 bp, Artificial Sequence
  Description of Artificial Sequence: Synthetic coding sequence
atgcacaaatggatactgacatggatactgcccacattgctgtataggagctgcttccatatcatctgtctggtaggtacaatcagcctcgcctgcaacgacatgacacccgaacagatggccactaatgtgaattgcagtagccctgagagacatacccgatcctatgattacatggaaggtggcgacatacgggtgcggcgcctgttttgccgcacccagtggtatctgcgcatcgataaacggggaaaagtaaagggaacgcaggagatgaagaataactacaacataatggaaatccgaacagttgcagtggggattgtggcaatcaagggagtggaatccgagttctatctcgccatgaataaggagggcaagctgtatgcaaaaaaagaatgcaatgaagattgtaattttaaggaattgattcttgagaaccattataacacatacgcaagtgcaaaatggacgcataatggtggagagatgtttgttgccctgaatcagaaggggatccctgtgcgagggaagaagaccaaaaaggaacagaagacagcacactttttgcctatggctattacc

SEQ ID NO: 32772 - DNA, 582 bp, Artificial Sequence
  Description of Artificial Sequence: Synthetic coding sequence
atgcataagtggatccttacttggattcttccgactctgctgtaccggtcgtgttttcatatcatctgtctcgtgggaaccatatccctggcgtgtaacgatatgacccctgaacaaatggcaactaacgtcaactgttcttccccagaacgtcatactagatcgtacgattacatggagggcggcgacatccgagtgcgacggcttttctgtcgaacccagtggtaccttagaattgacaaacgcggtaaggtcaagggaacccaagaaatgaagaacaactacaatatcatggaaattagaacggtggccgtgggcattgtggcgatcaaaggtgtcgagtccgaattctacctggcgatgaataaagagggtaaactgtacgctaagaaggaatgcaatgaggattgcaactttaaagaactcattctggaaaaccactacaacacctacgcctccgcgaagtggactcacaacggaggagagatgtttgtggcacttaaccaaaaaggaattcctgtgcgcggcaaaaagaccaagaaggaacaaaagacggcccacttccttcccatggcaattacc

SEQ ID NO: 32773 - DNA, 582 bp, Artificial Sequence
  Description of Artificial Sequence: Synthetic coding sequence
atgcacaagtggatcctcacctggattctcccaactcttctttaccggtcgtgtttccatatcatctgtcttgtgggaactatttcgctcgcatgtaacgatatgacccctgaacagatggcaaccaacgtcaactgttcctcgccagaaagacatacgagatcgtacgattacatggaaggaggtgacatacgggtgcgcagacttttctgtagaacccaatggtaccttagaattgacaaacggggaaaggttaagggaactcaagaaatgaagaacaactacaatatcatggaaattcgaaccgtggctgtggggattgtggccattaagggagtggagtcagaattctaccttgcaatgaacaaagaaggaaagttgtacgccaaaaaggaatgtaatgaagattgcaactttaaagaacttattctggagaaccactacaacacttacgccagcgccaagtggacccataacggaggtgaaatgttcgtggcactgaatcaaaaagggattcccgtgagggggaagaaaacgaagaaagagcaaaagactgcacatttcctccccatggcaataact

SEQ ID NO: 32774 - DNA, 582 bp, Artificial Sequence
  Description of Artificial Sequence: Synthetic coding sequence
atgcataagtggatccttacttggatcttgccaactctgttgtaccgcagttgttttcacatcatttgccttgtgggtaccattagcctggcttgcaacgatatgacacccgagcagatggccaccaacgtcaactgcagctcccctgagagacataccaggtcctatgattatatggagggaggcgacatccgtgtgcgccgcctgttctgcaggacccaatggtacctcagaattgacaaacgcggtaaagtcaaaggaactcaggagatgaagaataactacaacatcatggagatcaggaccgtagctgtgggcatcgtggctattaaaggtgtggagagtgagttttatctcgccatgaacaaggagggaaagctgtatgcaaagaaagaatgcaacgaagactgtaacttcaaggagctgatcctcgagaaccactacaacacctatgcttctgctaagtggacacataacggtggtgagatgtttgtggccctgaatcagaagggtattcccgtccgcggtaagaagactaagaaagaacagaagactgctcatttcctccccatggccatcacc

SEQ ID NO: 32775 - DNA, 582 bp, Artificial Sequence
  Description of Artificial Sequence: Synthetic coding sequence
atgcataagtggatcctcacctggatcctgcctactctgctctacaggagctgcttccatatcatctgcttggtcggtaccatttccctggcttgtaatgatatgactcctgaacaaatggcaaccaacgtgaactgctcgtcgccggaacgccatactcggtcgtacgactatatggaaggaggagacattcgcgtgcggcgcctcttttgtcgaacccagtggtacctgcggattgataaaagaggaaaggtgaagggaactcaggagatgaagaacaattacaacataatggaaatccggaccgtagcggtgggcatcgtggcgatcaagggagtcgagtccgagttttacttggcgatgaacaaagaaggaaagctctacgccaagaaggagtgcaatgaagattgtaatttcaaggaactgatcctggagaaccactacaatacctacgcctcggcaaagtggactcacaacggcggagagatgttcgtcgcactcaaccagaagggcattccggtgcggggcaaaaagactaaaaaggagcaaaagactgctcacttcctgccgatggcgatcacg

SEQ ID NO: 32776 - DNA, 582 bp, Artificial Sequence
  Description of Artificial Sequence: Synthetic coding sequence
atgcataagtggatcctgacttggatactgccaactctgctttaccgcagctgttttcacatcatatgtcttgtgggtaccatttcgttggcctgtaatgatatgactcccgaacagatggcaaccaatgtcaattgcagctcaccagagaggcacaccagatcttacgactatatggaagggggcgatattcgtgtgaggcgacttttctgccgaacccagtggtaccttagaatcgacaagcgtggaaaggtgaaaggaacccaggaaatgaaaaacaactataacatcatggaaattaggactgttgcagtcggcattgtggctattaagggtgtggaatcagagttctacctcgccatgaataaagaaggaaagctctacgctaagaaagagtgcaatgaggattgtaactttaaggaactgatcctggagaaccactacaatacctatgcatcagcgaagtggacccacaacggaggcgaaatgtttgtcgccctgaaccagaaggggatacctgtgcgtggaaaaaagaccaagaaggaacaaaagacggcacattttctcccgatggccataacc

SEQ ID NO: 32777 - DNA, 582 bp, Artificial Sequence
  Description of Artificial Sequence: Synthetic coding sequence
atgcacaaatggattctcacttggatcctgccgactctgctttacagatcctgctttcacataatctgcctggtgggcacgatcagccttgcctgcaacgacatgaccccagaacagatggccactaacgtcaactgttcgagcccggagagacatacccgatcatacgactacatggaaggcggagacatccgcgtgagacgtctgttctgcaggacgcagtggtacctgcggattgataagaggggcaaggtgaagggaactcaggagatgaagaacaattacaatatcatggaaatccgcaccgtggcagtggggatcgtggcgatcaagggcgtcgaaagcgagttctacctcgctatgaataaggagggtaagttgtacgcgaaaaaagagtgcaacgaggattgcaacttcaaggagctcattctggaaaaccactacaatacctacgccagcgccaaatggactcataatggaggagagatgttcgtggcgctgaaccagaaaggaatcccggtgagaggcaagaaaaccaagaaagagcaaaagaccgcacatttcctccccatggccataact

SEQ ID NO: 32778 - DNA, 582 bp, Artificial Sequence
  Description of Artificial Sequence: Synthetic coding sequence
atgcacaaatggatcttgacttggatcctcccaacccttttgtacagatcatgctttcacataatttgcctggtgggaacgatctcgctggcctgcaacgatatgactccagaacagatggcgaccaacgtcaactgttcctcccctgagagacatacgcgcagctacgactacatggagggcggagacattcgggtgagacgcctgttctgccgcacgcaatggtatctgcgcatcgacaagagaggaaaggtgaaaggcactcaagaaatgaagaacaattacaacatcatggagatacggaccgttgcggtggggatcgtggccatcaagggagtcgagagcgaattctacctcgcgatgaacaaggaggggaaattgtacgccaaaaaggagtgtaatgaagattgcaacttcaaggagctcatcctggagaatcattacaacacctatgcctcggcaaagtggactcacaacggtggcgagatgtttgtcgcactgaatcaaaagggcatccctgtgcgcggaaagaagactaagaaggaacagaagaccgcacacttccttcccatggctatcact

SEQ ID NO: 32779 - DNA, 582 bp, Artificial Sequence
  Description of Artificial Sequence: Synthetic coding sequence
atgcataaatggatcctgacctggatccttccgaccctcctgtaccggagctgttttcatatcatctgtttggtgggaaccatcagcctggcgtgcaatgacatgacgcctgaacaaatggccaccaatgtcaactgttcttcccctgaacggcacactcggagctatgattacatggaggggggtgatatccgggtgagaaggctcttctgtcgcactcagtggtacctgcgcatcgacaaaagagggaaggtgaagggaacccaagaaatgaagaataactacaacattatggagatccgcaccgtggcggtggggattgtcgccatcaagggcgttgaatcagaattctacctcgcaatgaacaaggagggaaagttgtatgcgaaaaaggaatgcaatgaggactgcaatttcaaagagctgatcctggagaatcattacaacacctacgcgtccgctaagtggacccacaacggcggcgaaatgttcgtcgccctcaatcaaaagggaatccctgtgaggggcaagaaaaccaagaaagagcaaaagactgctcattttctgcctatggccatcact

SEQ ID NO: 32780 - DNA, 582 bp, Artificial Sequence
  Description of Artificial Sequence: Synthetic coding sequence
atgcacaagtggatcctcacatggatcctcccgacgttactgtaccgatcttgtttccatatcatttgcctagttggcaccattagcctggcttgtaacgacatgacacctgagcagatggccacaaacgtaaactgctcttcccctgaacgccacactagatcctatgattatatggagggaggggacatccgcgtcaggcggttgttctgtcgcacccagtggtaccttcgaatagacaagcgcggcaaggtaaagggaacgcaggagatgaaaaataactacaatataatggagatcagaaccgtagccgtggggatcgtcgcgattaaaggagtggagagcgagttttatctggccatgaacaaagaggggaagttatacgctaaaaaggagtgcaatgaggattgcaatttcaaggaattaattcttgaaaaccactataacacgtatgccagcgcaaagtggacccataacggcggcgagatgttcgtggccctgaatcaaaaaggtatccctgtgcgggggaaaaagaccaaaaaggagcagaagaccgcccattttcttccaatggccatcaca

SEQ ID NO: 32781 - DNA, 582 bp, Artificial Sequence
  Description of Artificial Sequence: Synthetic coding sequence
atgcataaatggatcctgacctggattctccccaccctgctgtaccgctcatgtttccacattatctgcctggttggcactatctccctggcttgtaatgatatgacgccagaacagatggcgaccaatgtgaactgcagctcgcccgaacgccacactcgctcgtacgactacatggaaggtggagacatacgcgtgaggagactgttctgtaggacccagtggtaccttcgcatcgacaagagaggtaaggtcaaagggacccaagaaatgaagaacaactacaacattatggaaatccgcactgtcgctgtggggatcgtggcgatcaaaggagtggaatccgaattctacctggcgatgaataaggaaggcaagttgtacgcaaagaaggaatgcaatgaggactgcaacttcaaggagctcatcctcgaaaatcactataacacttacgcatcggcgaaatggactcataatggaggagaaatgttcgtggccctgaaccagaagggtattccggtgagggggaagaaaaccaaaaaagagcagaaaaccgcccactttctgccgatggcaatcact

SEQ ID NO: 32782 - DNA, 582 bp, Artificial Sequence
  Description of Artificial Sequence: Synthetic coding sequence
atgcataaatggattctcacttggattctccccaccttgctttataggtcttgttttcatattatatgtctggtgggcactataagtctggcctgcaacgacatgacccccgagcagatggccacaaacgtcaactgttcttcacccgaacgacacacacggtcttatgactatatggagggtggagacatacgcgtccgccgcctgttttgcagaacccagtggtacctccgcattgataagcgaggcaaagtgaaaggaactcaggagatgaagaataattacaatatcatggaaatacggactgtagctgtagggatcgtggcaatcaaaggggtcgagtctgagttctatctcgccatgaataaggaaggtaaactctatgcaaaaaaggaatgcaacgaagactgcaactttaaagagctgatcctggagaaccactacaacacctatgcctccgcaaagtggacacataacgggggcgaaatgtttgtcgcgctcaatcagaaaggtatccccgtgcgcggaaagaaaaccaagaaggaacaaaaaacagctcacttcctccccatggcaataacc

SEQ ID NO: 32783 - DNA, 582 bp, Artificial Sequence
  Description of Artificial Sequence: Synthetic coding sequence
atgcataaatggattctcacctggattctgcccactcttctgtaccggagctgttttcacattatctgtctggtgggcactatttcgctggcctgcaacgacatgacccccgaacagatggcaacgaatgtgaactgctcctcacctgagcgtcacaccagatcgtacgattacatggaaggaggagatatcagagtgagacgcctcttctgtcgtactcaatggtacttgagaatcgataagagagggaaggtcaaaggaactcaggagatgaagaataactataacatcatggaaatcaggactgttgctgtgggaattgtggccatcaagggggtggagtcagagttttacctcgcaatgaataaagaaggcaaactttacgccaagaaagagtgcaatgaagattgtaactttaaggaactgattctggaaaaccactacaacacctacgcttcggcaaagtggacccataacggcggcgaaatgttcgtggcacttaaccaaaagggcattccggtccgcgggaagaaaacgaagaaggaacaaaagacggcccactttctcccaatggctataacc

SEQ ID NO: 32784 - DNA, 582 bp, Artificial Sequence
  Description of Artificial Sequence: Synthetic coding sequence
atgcataagtggatccttacttggatcctgcctacgctcttgtaccgctcctgcttccacatcatttgcctcgtcgggaccatcagcctcgcctgtaatgacatgaccccggagcagatggcaactaatgtgaactgctcgtcgccggagcgccatactcggtcatacgattacatggaaggaggggatatccgcgtcagacggctgttttgccgcacccaatggtacctgcgaatcgacaagagaggtaaggttaagggaactcaggaaatgaaaaataactataacattatggaaatcaggaccgtggctgtcggaattgtggctatcaagggcgtggaatccgagttttacctggcaatgaacaaggaaggcaagctgtacgccaagaaagaatgtaacgaggactgcaacttcaaagagctgatcttggagaatcactacaacacctacgcgagcgccaaatggacccacaatggaggagaaatgttcgtggcgctgaaccagaagggaatccccgtgcggggcaagaaaacgaagaaagaacaaaagactgcccacttcctcccaatggcgatcacc

SEQ ID NO: 32785 - DNA, 582 bp, Artificial Sequence
  Description of Artificial Sequence: Synthetic coding sequence
atgcataagtggatcctaacctggatattgcctaccttattgtataggtcctgttttcatatcatttgcctagtggggaccatctccctagcctgcaatgacatgacccccgagcagatggccacaaatgtgaactgtagctccccggaacggcacacccgatcttacgattacatggagggaggcgacatacgcgttaggagattattctgtcgcacccaatggtatctgaggattgacaaacgagggaaagtgaagggaacacaggaaatgaaaaacaactataacatcatggagattcgcaccgtggcggtgggcatagtggccattaagggagtggagtccgagttctatctggcaatgaataaggagggaaagctgtacgccaagaaggaatgcaacgaggattgtaacttcaaggaactcatcctggagaaccactacaacacttacgcgtctgcaaaatggacccataatggtggtgagatgttcgtggcattgaaccagaaaggtataccggttcgtggtaaaaagactaaaaaggagcagaaaactgcacacttcctgcctatggcgattact

SEQ ID NO: 32786 - DNA, 582 bp, Artificial Sequence
  Description of Artificial Sequence: Synthetic coding sequence
atgcataaatggattctcacatggatactgccaactttattgtaccgaagttgtttccatatcatttgcttggttggcaccatatctctggcgtgcaacgatatgacaccagagcaaatggctacaaacgtcaattgcagttcccctgagcggcacacccgtagctacgactacatggagggcggcgacataagggtgcgacggctcttctgcagaacccagtggtatcttcgcattgacaagaggggaaaggtgaagggcactcaggagatgaagaataactacaacatcatggagatccggaccgtggctgtgggcatagtggccatcaagggggtagagtcagagttctacctcgccatgaataaagagggaaagctgtacgctaagaaagaatgtaacgaggattgtaattttaaggaactgattcttgagaaccattacaatacctacgcaagtgctaaatggacgcataacggaggtgagatgtttgttgcactcaaccaaaaggggatccctgtgcgagggaaaaagaccaagaaagagcagaagaccgcccattttctcccgatggccatcaca

SEQ ID NO: 32787 - DNA, 582 bp, Artificial Sequence
  Description of Artificial Sequence: Synthetic coding sequence
atgcataagtggatcctcacctggatactgcccaccctattatatagatcgtgttttcacataatctgcctggtggggactatctctttggcctgcaacgatatgaccccagagcagatggctaccaacgtgaactgttcctctccggaacgacataccagatcatacgactacatggaggggggagacattcgagttaggagactattctgtcgcacacagtggtatctgcgaattgacaagcgggggaaggttaaaggtactcaggagatgaaaaataattacaacatcatggagattaggactgttgccgtgggcatcgtggccattaagggcgtcgaatccgagttttacctggccatgaacaaagaaggcaagctgtatgcgaagaaggaatgcaacgaagactgtaactttaaagagctcatacttgaaaatcattacaacacgtacgctagcgccaagtggacgcacaacgggggagagatgtttgtggctctaaatcagaaaggtatacctgtgaggggaaaaaaaacaaaaaaggaacagaaaaccgcacacttcttgccgatggcgatcact

SEQ ID NO: 32788 - DNA, 582 bp, Artificial Sequence
  Description of Artificial Sequence: Synthetic coding sequence
atgcacaaatggatccttacttggatcctgcctactttgctgtaccggtcatgcttccacattatctgcctggttggcaccatttcccttgcttgtaatgacatgactccagaacagatggccaccaatgtgaactgctcgtccccggaacgccatacgcgctcatacgactacatggaaggcggggacatccgggtgagacgcctcttctgcagaacccagtggtacttgaggatagacaaacggggaaaagtcaagggaactcaggaaatgaagaacaattacaacatcatggaaattcggaccgtcgcagtggggatcgtggccatcaagggtgtggaatcagaattctacctggctatgaacaaggaggggaaactgtacgccaagaaagagtgtaatgaggactgcaactttaaagaactgatcttggaaaaccactacaacacgtacgcgtcggcgaagtggacccataacggtggcgaaatgttcgtggctctcaaccaaaaggggattcccgtccgaggaaagaaaaccaagaaggaacagaaaactgcgcatttccttccgatggccatcacg

SEQ ID NO: 32789 - DNA, 435 bp, Artificial Sequence
  Description of Artificial Sequence: Synthetic coding sequence
atggcaacctgggcactcttactcctcgccgcaatgttgctggggaatccgggtcttgtcttttctcgtttatccccagagtactacgatcttgcccgagctcacctgagggacgaggaaaagtcttgtccttgcctcgcgcaagaaggtccacaaggcgaccttcttaccaaaacacaggagctgggcagagattatcgaacctgcctgaccattgttcagaagctgaagaagatggtggacaaacctacccaacgtagtgtttctaatgcagccacacgtgtttgccgtacaggccgctcgcggtggagagatgtctgccgtaatttcatgaggcggtaccaaagtcgggttacgcaagggcttgtcgctggcgagactgcacagcaaatatgcgaagatttgcgtctttgtattcccagtacagggcctctc

SEQ ID NO: 32790 - DNA, 435 bp, Artificial Sequence
  Description of Artificial Sequence: Synthetic coding sequence
atggccacatgggccctgctgctgcttgctgccatgttgttggggaacccaggtctggtgttttccagactgtcgcccgagtactacgaccttgctagggcacacttgcgggacgaagaaaaatcttgtccctgtctggcgcaggagggtccccagggggacttgctgactaagacccaggagcttgggagggattacaggacatgtctgaccatcgtccagaaactaaagaagatggtagacaagccaacccagaggtcagtgagcaacgcagcaacacgggtctgcagaacagggcggagcaggtggagagatgtttgccggaattttatgagacgctatcagtcccgcgtcacgcaaggcctagtggcaggtgaaaccgctcagcaaatttgcgaggatctgcggctgtgtatcccatccacagggcctctg

SEQ ID NO: 32791 - DNA, 435 bp, Artificial Sequence
  Description of Artificial Sequence: Synthetic coding sequence
atggcgacttgggctctgctgctgctcgccgctatgctgctgggaaaccctggtctggtcttttcgcggctcagcccggagtactacgatctcgcgcgcgcccatctgcgggatgaagagaagagctgcccgtgcctggcccaagaggggccgcagggtgacctgcttaccaaaactcaggagttgggccgcgactaccgtacttgcctcaccatcgtgcaaaagctgaagaagatggtggacaagcctacccagcggtcggtgtccaacgcagcgactcgggtctgccggactggacggtcccggtggcgggacgtgtgcagaaatttcatgcgccggtaccagtcgcgggtcacccaaggactcgtggccggagaaacggcccaacagatctgcgaggacctcaggctctgtatcccgtccacgggcccactc

SEQ ID NO: 32792 - DNA, 435 bp, Artificial Sequence
  Description of Artificial Sequence: Synthetic coding sequence
atggccacttgggcgctcctgctcctggctgcaatgttgctcggcaacccaggcctcgtcttcagcaggctctccccagaatactatgatcttgccagagctcacctcagggacgaggagaaatcctgtccctgcctggctcaggaaggccctcaaggtgacctgctgaccaagacccaggagctgggccgcgactatcgcacgtgtctcactattgtgcagaagctgaagaagatggttgataaacctactcaaagatccgtgtccaacgcagctacccgcgtatgccgcacaggccgctccaggtggagggacgtgtgccgcaacttcatgcgccgctaccagagcagggtgactcagggcctggtggccggagagactgctcaacagatctgcgaggacctccgcctgtgtattccttctaccggccctctg

SEQ ID NO: 32793 - DNA, 435 bp, Artificial Sequence
  Description of Artificial Sequence: Synthetic coding sequence
atggctacttgggcgctgctgctcctggcagctatgctgttggggaaccctggtctggtgttctcacgcctgtcccctgagtactacgacttagctagggcccatctccgagatgaggagaagagttgcccgtgtctggcacaggaggggcctcaaggggatctcttaaccaaaactcaagagctggggagggactacaggacctgcttaacaatcgtgcagaaactcaagaagatggtggacaaaccaacccagcgctcggtaagcaatgctgctacccgggtgtgtaggactggacggtcacggtggcgcgatgtgtgcaggaatttcatgcgccggtatcagtcgagagtcacgcaggggctagtggccggggaaaccgcgcagcaaatatgcgaagacctcagattgtgcattccctccacgggtccgttg

SEQ ID NO: 32794 - DNA, 435 bp, Artificial Sequence
  Description of Artificial Sequence: Synthetic coding sequence
atggcgacttgggcattgctgctcctggccgcgatgctgctgggcaacccgggactggtgttctcccgtctctcgccagagtactacgatctcgcgcgcgcgcacctgagggacgaagagaagtcgtgcccgtgcctggcccaagaaggaccccagggagatctcttgaccaagactcaagaactcggccgcgactaccggacttgccttacgatcgtccaaaaactgaaaaagatggtggataagccaacccagcgctcagtctcaaacgccgctacccgcgtctgccggactgggcggagccgctggcgagacgtgtgtcggaacttcatgcgccgctaccagtcgagggtgacccagggactcgtggccggcgaaaccgcacagcaaatctgtgaggacctgagactgtgtattccgtccaccggacctctg

SEQ ID NO: 32795 - DNA, 435 bp, Artificial Sequence
  Description of Artificial Sequence: Synthetic coding sequence
atggcaacgtgggcacttctgctgctcgctgccatgttgcttggcaaccctggactcgtgttttccaggctgtctcctgagtactacgacctggcacgcgcgcacctgagagacgaagaaaagtcatgcccgtgtctcgcccaagagggccctcaaggtgacctgctcaccaagacccaggagttgggaagagattatcgcacctgcttgactatcgttcaaaagctcaagaaaatggtggataagccgactcagaggtcggtgtccaatgccgccacccgagtctgccgtacgggacgctcaaggtggcgcgacgtgtgccgcaacttcatgagacgctaccagagtagagtgactcaggggctcgtcgctggagaaactgcacagcagatctgtgaagatttgcgcctctgcattcctagcaccggtccgctc

SEQ ID NO: 32796 - DNA, 435 bp, Artificial Sequence
  Description of Artificial Sequence: Synthetic coding sequence
atggccacttgggctcttctgctactggcggcaatgctgttggggaacccaggcctggtattctctcgcctctcccccgagtattacgacctcgccagagcgcatcttcgcgatgaagaaaaaagttgcccttgtttggctcaggaagggcctcagggggatttactgaccaagactcaggagctgggtagggactaccgaacctgcctaacgattgtgcagaagttaaagaagatggtagacaagcccactcagaggagcgtctctaatgctgctacccgggtgtgcaggactggacgttcaaggtggcgcgatgtgtgtcgaaacttcatgcgcaggtaccagtccagggtgactcagggcttggtggcaggagagactgcccagcagatttgcgaggatttacgactttgtataccatccactggaccgctc

SEQ ID NO: 32797 - DNA, 435 bp, Artificial Sequence
  Description of Artificial Sequence: Synthetic coding sequence
atggctacctgggcacttttgctgctggccgctatgcttcttggaaatccgggtctggtcttttccagactttccccagaatactacgatctggccagagcacacctccgcgacgaagaaaagagctgtccttgtctggcacaagagggacctcagggagatctccttactaagactcaagaactcggccgcgattaccggacttgtctgaccattgtgcaaaagctgaaaaagatggtggataagccaactcaacgctcggtgagcaacgctgcaactagagtgtgtcgaactggtcgatcacgctggagggacgtgtgcagaaacttcatgaggaggtaccagtcaagagtgacccaaggtctggtcgccggagaaaccgcacagcagatatgtgaggaccttagactttgtattccttctaccgggcctctg

SEQ ID NO: 32798 - DNA, 435 bp, Artificial Sequence
  Description of Artificial Sequence: Synthetic coding sequence
atggcaacatgggcacttcttcttctggctgctatgctactcggaaaccctggactggtattttctcggcttagtccagaatattacgatttagcgagggcccatttaagagacgaagagaaatcttgcccctgcctggctcaagaaggaccacagggagacctcctgactaaaacacaggaattagggcgcgattataggacatgtcttactattgttcaaaagttaaagaagatggtagataaacccacacaacggtccgtatccaatgcagctacaagagtgtgccggacaggaaggtccagatggagagatgtctgtcggaatttcatgcgacgctatcagtcacgggtgacacagggattagtggcaggggagactgcgcagcagatttgcgaagaccttaggctgtgcatcccctcaactgggcccctc

SEQ ID NO: 32799 - DNA, 435 bp, Artificial Sequence
  Description of Artificial Sequence: Synthetic coding sequence
atggccacgtgggctctccttctgctcgccgccatgctcctgggtaatccagggctggtcttcagcagactctcgccagaatattatgacctggcacgcgcccatttgcgagatgaagaaaagtcgtgcccctgcctcgcgcaggagggtcctcagggagacctgctgacgaagacgcaggagttgggcagggattatcgcacgtgcctaaccattgtacagaaactgaaaaagatggtggataaacccacccaacgttcagtcagcaatgccgccacccgtgtgtgtcgcacaggccgctcgcgttggcgcgacgtgtgtcgaaacttcatgcggagataccagagcagagtgactcagggactcgttgccggcgaaaccgctcaacagatttgcgaggatctgcgactttgcatcccgtcgacaggccctctc

SEQ ID NO: 32800 - DNA, 435 bp, Artificial Sequence
  Description of Artificial Sequence: Synthetic coding sequence
atggcaacttgggcccttcttttgctcgcagcaatgctgctgggaaacccagggctcgtcttttcacgcctctcgccagagtactacgatctcgctagagcccatctgcgggacgaagaaaaatcctgtccttgcctggcacaggaaggacctcagggggatctgctcaccaagactcaagaactcggtcgagactaccggacctgtctgacgatagtccagaaactcaagaagatggtggataagcctacccagagaagcgtgtcgaacgccgcgacccgtgtgtgtcgaactggtcgtagccgctggagagatgtgtgtaggaatttcatgagacgataccagtcgcgggtcacccaaggactggtggcaggcgaaaccgcacagcaaatctgcgaggatttgagactctgtatcccgtcgaccgggcctctg

SEQ ID NO: 32801 - DNA, 435 bp, Artificial Sequence
  Description of Artificial Sequence: Synthetic coding sequence
atggcgacttgggcactccttctcctcgccgctatgcttctgggtaaccctggtcttgtcttttcaagactttcacctgagtactacgacctcgccagggcacatcttagagatgaggaaaaatcgtgcccttgtcttgcgcaggaagggcctcagggagatctgcttaccaagacccaggagttgggccgagattaccgcacttgcctgactattgtgcaaaagctgaagaagatggtcgacaaacccacccaacgaagcgtcagcaacgccgcgaccagggtctgcaggaccggcagatcgcgctggcgtgatgtgtgtcggaactttatgcgcagatatcagtcccgtgtcacccaagggctggtggcaggtgaaacggcacaacagatttgcgaggatcttcgcctttgtattccttccaccggacctctt

SEQ ID NO: 32802 - DNA, 435 bp, Artificial Sequence
  Description of Artificial Sequence: Synthetic coding sequence
atggccacctgggctctgctccttctggcagctatgctcctgggtaaccctggccttgtcttttcgagactgtcccctgagtactacgaccttgcacgtgcccatcttagagacgaggaaaagagctgcccctgcctggcccaagaaggaccccagggagatctgctgacgaaaactcaggaacttggaagagactacaggacctgcctcaccattgtgcaaaagctgaagaagatggtggacaaacctacgcagagatccgtgtcaaatgcagcaactcgggtttgtcgcactggaagaagcaggtggagagatgtgtgtaggaactttatgcgacgctaccaatccagagtgacccaaggccttgtcgccggcgaaaccgctcagcaaatctgtgaggatctgagactgtgtattccatcgaccggtcctctc

SEQ ID NO: 32803 - DNA, 435 bp, Artificial Sequence
  Description of Artificial Sequence: Synthetic coding sequence
atggcaacttgggccttactgctgctggccgcgatgctgttgggcaaccctggtttggttttctcgcgtctttccccagagtactacgacctggctcgagcacatctgcgcgacgaagagaagtcttgcccgtgcctcgctcaggaaggtccccaaggcgacctgctgactaagacacaagaactcgggagagactacaggacttgtctcaccatcgtgcagaagctgaaaaagatggttgacaaacccacgcagcgtagcgttagtaacgcggccaccagggtgtgtcgaacgggccgcagtcgctggcgggacgtttgccggaactttatgcgccggtatcagtcgcgggtcactcagggtctggtggccggtgaaactgctcaacaaatctgtgaggatctcagactttgtatcccatctaccggccctctg

SEQ ID NO: 32804 - DNA, 435 bp, Artificial Sequence
  Description of Artificial Sequence: Synthetic coding sequence
atggccacatgggctttgctgttgctggctgcgatgctgttagggaatccagggctcgtgttttcgcgactcagtccagaatattatgacctggcacgggcccatctgagagatgaagagaagagctgtccctgtctggcccaggaaggccctcagggtgacttactgactaaaacacaggaactaggtagggattacagaacatgcctgaccattgttcaaaaattgaagaaaatggtggacaaacctacccagcggtccgtgagcaacgcggcaacacgtgtttgtagaaccggacgttctcgctggagggatgtgtgtcgcaatttcatgcgtaggtatcaatcaagggttacccagggcctcgttgctggggaaacggcccagcaaatctgtgaagacctgcgcctgtgtataccttccactggtcctctg

SEQ ID NO: 32805 - DNA, 435 bp, Artificial Sequence
  Description of Artificial Sequence: Synthetic coding sequence
atggcaacttgggcgctccttctcctggccgccatgctcctcggaaacccgggacttgtcttttcgagactttcgccggaatactacgatcttgcgagagctcacctgcgcgatgaagaaaagtcgtgtccgtgcctggctcaagaggggccgcagggtgacctgcttaccaagacccaggaactgggccgcgactataggacctgcctgaccattgtccaaaaactgaagaaaatggtggacaagccgacgcagaggagcgtgtcaaatgcagccactcgcgtttgtcgcaccggccgctctcggtggcgggacgtctgccgcaatttcatgagacgctaccagtcgcgggtcactcagggactcgttgcgggtgaaaccgcccaacaaatctgtgaggacttgcgcctgtgcatcccatccaccggaccgctg

SEQ ID NO: 32806 - DNA, 435 bp, Artificial Sequence
  Description of Artificial Sequence: Synthetic coding sequence
atggccacatgggcgctgctgctgctggcagcaatgctattgggaaacccaggattggtttttagccgcctgagtccagaatattacgatctggccagagcgcacctgagagatgaagaaaaatcctgtccatgccttgcccaggaagggccacagggagacctgctcactaagacccaggagctaggtagggactatcgcacctgtttaacaattgtccagaaactgaagaaaatggtggacaagcctacccaaaggtctgtctcaaatgctgcgacgagggtgtgccgtacaggaagatcgaggtggcgtgacgtctgtaggaactttatgcgccgttatcagtctcgcgtgacgcagggtcttgtggcaggtgagactgcacagcagatatgcgaggatcttagactatgtattccgagtaccgggcccttg

SEQ ID NO: 32807 - DNA, 435 bp, Artificial Sequence
  Description of Artificial Sequence: Synthetic coding sequence
atggctacatgggctctgttgcttctggctgcaatgctgctgggcaaccctggattggtgttctctaggttgtctcccgaatactacgacctcgcacgtgctcacctcagagacgaagagaaaagttgcccatgcctggcacaagagggacctcaaggtgacctcttgacaaagactcaagaactgggaagggattaccgtacttgtctgaccatcgtgcagaaattgaagaagatggtcgacaaaccaactcaacgctccgtatccaacgcagccaccagagtttgtaggactggacgttcaaggtggcgcgatgtgtgccgcaactttatgagacgttaccagagccgcgttacccaaggacttgtggcaggcgagactgctcagcagatttgcgaggatctccgcctctgcatcccctccacaggccccttg

SEQ ID NO: 32808 - DNA, 435 bp, Artificial Sequence
  Description of Artificial Sequence: Synthetic coding sequence
atggctacgtgggccctcctcctgttggcggcaatgctgctgggaaatccgggtttggtcttttcacgcctgtccccagagtactacgatctggcacgcgcccaccttagagacgaggaaaagtcctgtccgtgcttggctcaggagggaccacaaggcgatctgcttaccaagactcaggaactcggtcgggactaccgcacttgcctcactattgtgcagaagctcaagaagatggtggacaagccgacccagcggtccgtgtcgaatgcggcaacccgggtgtgtcgaaccggaagatcacgctggagagacgtgtgtagaaacttcatgcggcggtatcaaagccgcgtgactcaggggctggtggctggagaaactgcgcaacagatctgcgaagatctgcggctctgcatcccatccactggtccactg

SEQ ID NO: 32809 - DNA, 435 bp, Artificial Sequence
  Description of Artificial Sequence: Synthetic coding sequence
atggccacgtgggctctgttgctcctagcagcaatgcttctcggtaatccgggtctggtgttctcaagactgtcgcctgagtattacgacctcgcacgggcccaccttagggatgaagaaaagagttgcccgtgcctggcgcaggagggtccacaaggggatctgctgaccaaaacccaggaacttgggcgcgactaccgaacttgtctgacaatcgtgcagaagctgaaaaagatggtcgacaaacccacacagcgtagtgtgtcaaacgcagccaccagagtttgccgtaccggacggtctagatggcgggatgtgtgcagaaacttcatgaggaggtaccaatccagggtaactcaggggctagtcgctggcgagacagcgcagcagatttgtgaagaccttcggctttgtataccatctaccggacctctt

SEQ ID NO: 32810 - DNA, 435 bp, Artificial Sequence
  Description of Artificial Sequence: Synthetic coding sequence
atggccacctgggcactcctcctgctggccgcaatgctcttgggaaaccccggactcgttttttctagactatccccagaatactacgaccttgctagagcgcacttgcgggacgaggagaagtcttgtccgtgccttgcccaggagggacctcagggcgaccttctgaccaagacccaagaacttgggcgggactaccgcacctgtttgaccatagtgcagaagttgaagaaaatggtagacaaacccacgcaaaggtccgtgagtaatgccgctacccgggtgtgcaggactgggaggtcccgatggagagatgtgtgtaggaactttatgcgtcgataccagagcagggtcacccagggacttgtcgcgggtgagacggcccaacagatttgtgaggaccttcggttgtgcataccatcaacgggccctctc

SEQ ID NO: 32811 - DNA, 435 bp, Artificial Sequence
  Description of Artificial Sequence: Synthetic coding sequence
atggcaacctgggcgctcttgcttctggctgcgatgctcctcggaaacccaggccttgttttttcccgcctgtcgccagaatactacgatctcgcgcgcgcccacctgcgggacgaagagaagtcgtgcccttgcttggcccaggaggggccgcagggcgacctcctgaccaaaacccaggaactcggtcgggattacaggacttgcctgactattgtgcaaaagctgaagaaaatggtcgacaagccgactcagcgcagcgtgtctaacgcagctacgagagtgtgccgaactgggagaagcagatggcgggatgtgtgccgcaatttcatgcggcggtaccaatcaagggtgacccagggactggtcgccggagaaaccgcccagcaaatctgtgaggacctgcgcctgtgtatcccgtccactggacccctg

SEQ ID NO: 32812 - DNA, 435 bp, Artificial Sequence
  Description of Artificial Sequence: Synthetic coding sequence
atggcaacatgggctctgctgctgctggcagctatgctcctgggaaaccccgggcttgttttcagccgccttagcccagagtattacgacctggcaagagcccaccttcgagatgaagaaaaatcttgtccatgtctggcccaggaagggcctcagggagacttgttaaccaagactcaggaactgggcagggactaccggacctgcctgacaatcgtgcaaaaactgaagaaaatggttgacaagcccacccaacgctctgtgtcaaatgccgccacacgggtttgccggaccgggcgttcccgttggcgggacgtgtgccgtaatttcatgcgcagataccagtccagagtaacccagggtctcgtagcgggtgaaacagcccagcaaatctgcgaggaccttaggctatgcataccttctacaggccctctc

SEQ ID NO: 32813 - DNA, 435 bp, Artificial Sequence
  Description of Artificial Sequence: Synthetic coding sequence
atggctacgtgggccctgcttctgctcgccgccatgctcctcgggaacccggggctggtgttctccagattgtcccccgagtactacgatttagccagagctcacctgcgggacgaggagaaaagttgcccatgcttggctcaggaaggcccacaaggggacctgctgactaaaacccaggagctgggaagagactacagaacctgtcttacgattgtacagaagcttaaaaaaatggtcgataaaccaacccagagatccgttagcaacgctgctactcgggtatgtcgtacgggaaggtctcgctggagggacgtgtgtcggaactttatgaggcgatatcaaagtcgggtgacacaaggcttggtcgctggcgagaccgcccagcagatctgcgaggatctgcggctctgcatccctagcactggaccactg

SEQ ID NO: 32814 - DNA, 435 bp, Artificial Sequence
  Description of Artificial Sequence: Synthetic coding sequence
atggccacttgggctttgttactgttggccgcgatgttactcgggaaccccggcttggtgtttagtcggctaagtccggagtactatgacctggctagggcccacctgagagacgaggagaagtcctgcccttgccttgctcaagagggcccacagggggacctgttgactaagacacaggaactgggtcgcgactatcggacatgtctgactatcgttcaaaaacttaaaaaaatggtggacaagccaactcagcgctccgtctctaatgctgctaccagggtttgtcggaccggacgctcacggtggagagacgtttgccggaattttatgcggagatatcagtctcgggttacccagggccttgtcgctggggagactgctcagcagatctgcgaagacctgagactatgcatcccttcaacagggcccctg

SEQ ID NO: 32815 - DNA, 435 bp, Artificial Sequence
  Description of Artificial Sequence: Synthetic coding sequence
atggctacctgggcccttctgctcctcgccgccatgctgctgggtaaccctggactggtgttcagtcgactgtctcctgaatattatgacctggctcgggcgcacctgcgggacgaagagaagtcctgtccatgccttgcacaggagggtccgcaaggggatttgctcacaaaaactcaggagttgggcagggattaccgcacctgtctaaccatcgtacaaaaactcaagaagatggttgacaagcccactcagaggagtgtgagtaatgccgcaacacgcgtatgccggaccggcagaagtagatggcgggacgtgtgtcgaaacttcatgcgccgctaccagtccagggtgacacaggggcttgtcgccggggagacagcacagcagatttgtgaagatctgaggctttgcatccccagcacaggcccctta

SEQ ID NO: 32816 - DNA, 435 bp, Artificial Sequence
  Description of Artificial Sequence: Synthetic coding sequence
atggctacctgggccctgctcttgctggccgcgatgctcctggggaatccgggtttggtgttcagcagactctcacctgaatactacgatttggcgcgtgcccatctccgcgatgaagagaagagctgcccatgcctcgctcaggaaggaccgcagggtgaccttctcactaagacccaagagctcggacgtgattacaggacctgtctgactatcgtgcagaagctgaaaaagatggtagacaaaccaacccaaaggtcagtgtcgaacgccgctactcgcgtgtgccggaccggacgctcccgctggcgcgacgtgtgtcggaacttcatgagaagataccaatcccgcgttacgcaaggattggtcgccggagaaactgctcagcagatttgcgaggacctccggctttgtatcccctcgacgggccctctt

SEQ ID NO: 32817 - DNA, 435 bp, Artificial Sequence
  Description of Artificial Sequence: Synthetic coding sequence
atggccacctgggctctactgcttcttgcagccatgctcctgggtaaccctggcctcgtattctcccggctctcacccgagtactatgacctggcccgagcgcacctgcgggacgaggaaaagagctgcccctgtttggcacaggaaggaccccagggcgaccttctaaccaagacccaggaactcggtagggactaccggacatgtctgacgatcgtccaaaagttgaagaagatggtggacaaaccaacacagcgatccgttagtaacgctgctactagggtgtgccggactggccgttctaggtggcgcgacgtctgtcgcaatttcatgaggcgataccagagccgcgtaacgcagggcttggtggcaggggagacggcacagcagatctgtgaggatttgagactgtgcatcccatccactggcccccta

SEQ ID NO: 32818 - DNA, 435 bp, Artificial Sequence
  Description of Artificial Sequence: Synthetic coding sequence
atggccacttgggctctgctcctcctcgctgccatgctgctgggaaacccgggcttggttttttctcggctctccccagagtactacgacctcgcgcgggcgcatttgcgggatgaagaaaaatcctgcccttgcttggcccaagaagggccacagggagatctgctgaccaagacgcaggaactgggacgagattacagaacttgcctcaccatcgtccagaagttgaagaagatggtggacaagccgactcaacggtcggtgtccaacgccgcaacccgggtctgcaggaccggcagatcacgctggcgagatgtgtgtcgcaatttcatgcgcaggtatcaatcgcgcgtgacgcagggactggtggccggggagacggcccaacagatctgtgaggacctccgcctctgcatcccgtctaccggcccgttg

SEQ ID NO: 32819 - DNA, 435 bp, Artificial Sequence
  Description of Artificial Sequence: Synthetic coding sequence
atggctacatgggctctgctgctgcttgctgcaatgttgttggggaaccccgggctggttttcagccggctgagtccggaatactatgatttggcccgagcacatctaagagacgaggaaaaatcctgtccttgcttagcacaggagggccctcagggcgatcttctgacgaaaacacaagagctgggtcgggactataggacttgcttaacaattgtccagaagctgaaaaagatggttgacaagccaactcaacgcagcgttagcaacgcagccacgagagtttgtcggactggccgctcacgttggcgtgatgtttgccgcaatttcatgcgacgctatcagtctcgggtgacgcagggccttgttgctggggaaacggcccagcagatctgcgaggacctacggctttgtattccctccaccggtcctctt

SEQ ID NO: 32820 - DNA, 435 bp, Artificial Sequence
  Description of Artificial Sequence: Synthetic coding sequence
atggcaacctgggcccttcttctcttggcagcgatgctgctggggaaccccggtctggtctttagccgcctctcccccgaatactacgatcttgcgagagcacatttgagagacgaagagaagtcttgtccgtgccttgctcaggaaggccctcaaggcgatcttctgaccaagactcaagaactgggacgcgattacagaacgtgcctcacgatcgtgcaaaagctgaaaaagatggtggacaaaccaactcagcggtcagtctctaatgcagccaccagggtttgtcggactggacggagcaggtggcgagatgtgtgccgcaacttcatgagacgctaccagtcgagagttactcaaggtcttgtggcaggagagactgcccagcaaatttgtgaggacttgcggctttgtattccttcaaccggtccactt

SEQ ID NO: 32821 - DNA, 435 bp, Artificial Sequence
  Description of Artificial Sequence: Synthetic coding sequence
atggcaacctgggcgcttctgctccttgctgctatgctcctgggcaacccagggctcgtattttcccgcctttcgcccgagtactacgacctggccagagcccatctgcgtgatgaagaaaaatcgtgtccttgcctggcgcaggagggcccgcaaggtgatttgttgactaagacccaagagctgggacgcgactatcgaacctgtcttaccatcgtacagaagttgaaaaagatggtcgataagcctactcaaagatcagtgagcaatgcagcaaccagagtctgccgaactggaagatcccggtggcgtgacgtgtgcaggaacttcatgaggcgttaccaaagccgggtgactcaaggacttgtggccggtgaaaccgcacagcagatttgtgaagatctccgactctgtattccatccactgggccactt

SEQ ID NO: 32822 - DNA, 435 bp, Artificial Sequence
  Description of Artificial Sequence: Synthetic coding sequence
atggcaacttgggcactgctccttctcgctgccatgctgctcggcaaccctgggttggtcttttctcgattgagcccggagtactatgatctggcacgggcccatcttcgggatgaagaaaagtcttgcccatgcctggctcaggagggtccccagggcgatctgctgaccaaaactcaggaactggggcgcgattatcggacgtgcctcaccatcgtgcagaaactgaagaagatggtagataagcccacacagagatccgtatctaatgcagccacgcgcgtgtgtaggactggacggagtcgctggcgggatgtctgcagaaatttcatgcgccggtaccaaagccgcgttacgcagggactcgtggctggcgagactgcacagcagatttgcgaggatctccgactgtgtattccgagtaccggccctctc

SEQ ID NO: 32823 - DNA, 435 bp, Artificial Sequence
  Description of Artificial Sequence: Synthetic coding sequence
atggcgacttgggccctgctcctactggcagcaatgctcttaggtaatccgggccttgtgtttagccgcctgtcccctgaatactacgatctagcacgtgctcacctgcgggatgaggaaaagtcatgtccatgtctggcccaggaaggacctcaaggtgatttgctcacgaagactcaggaactgggtagagattacaggacgtgcttaacgattgtgcagaaactgaaaaaaatggttgataagcctactcagaggtctgtgtcgaatgccgccacaagagtatgtcggaccggaaggagccgctggcgagatgtatgtagaaatttcatgaggcgctatcagtctcgcgttacacagggcttagtagcaggggaaactgcccaacagatatgcgaggacctgcggttgtgtatcccatcaaccggacctttg

SEQ ID NO: 32824 - DNA, 435 bp, Artificial Sequence
  Description of Artificial Sequence: Synthetic coding sequence
atggccacgtgggctcttttactacttgctgcaatgctcttaggaaaccctggactcgtgttttcccgtctttcccctgagtactacgatctagctagagcacacttgcgggatgaggaaaagtcatgtccgtgcctggcccaagaaggaccgcaaggtgatctgctgaccaaaacccaggagctgggaagggactaccgcacttgcctgacaatcgtgcagaagcttaagaagatggtcgacaagcccactcaaaggtcagtgtcaaacgcggcgaccagagtttgcaggacaggaagaagcagatggcgcgatgtgtgccgcaattttatgagaagatatcaaagccgtgtcactcagggtctggttgctggagagacagcgcaacagatctgtgaggacctgagactgtgcatccctagcactgggccgctg

SEQ ID NO: 32825 - DNA, 435 bp, Artificial Sequence; identical to SEQ ID NO: 32812
  Description of Artificial Sequence: Synthetic coding sequence

SEQ ID NO: 32826 - DNA, 435 bp, Artificial Sequence
  Description of Artificial Sequence: Synthetic coding sequence
atggccacctgggcactcctgcttctggcggccatgctgctggggaatcctggtctggtgttttcacggctgagccctgaatactacgatcttgcacgcgcgcacctgcgcgatgaggagaagtcgtgtccgtgcctcgcacaagaaggccctcagggagatctccttaccaaaactcaagaactcggcagagactacagaacttgccttaccatcgtgcaaaaactgaagaagatggtggataaacctacccaaagatcagtctctaacgcagcaacccgtgtgtgtcgaactgggagatcaagatggcgcgatgtgtgtcggaatttcatgagacggtaccagtcgcgtgtgacccagggactggtggcaggtgagactgcccaacaaatctgcgaggaccttcgactgtgtatcccatcgaccggccccctg

SEQ ID NO: 32827 - DNA, 435 bp, Artificial Sequence
  Description of Artificial Sequence: Synthetic coding sequence
atggcaacctgggcccttttgctcctggcagccatgctgctgggaaatcccggacttgtgttttcccgtctgtcgcctgaatactacgaccttgccagagcacatctgagagatgaagaaaagtcctgtccttgtctggcgcaagaaggtcctcaaggagatctgttgaccaagacccaagagttgggtagagattaccgaacctgcctcaccatcgtccagaagctgaagaagatggtggataagccaacccagcgctcggtgtcgaacgctgcgactcgcgtgtgtagaaccggaaggagccggtggcgggatgtgtgccggaactttatgcgcagataccagagccgagtcactcagggtctggtcgcaggagaaactgcacaacaaatttgtgaggacctgcggctttgtattccttcaactggtccgctg

SEQ ID NO: 32828 - DNA, 435 bp, Artificial Sequence
  Description of Artificial Sequence: Synthetic coding sequence
atggccacctgggcacttttgctgcttgcagcaatgcttcttggaaatcctggccttgttttctctcgactgtccccggagtactatgatctcgcgcgcgcacacttgagggacgaagaaaagagctgtccatgtctggcccaggaaggacctcagggtgatctgcttacgaaaacccaggaactgggacgtgattacagaacgtgtttgactattgtgcaaaaactgaagaagatggtggacaagccaactcaacgatcggtatcaaacgcagcgaccagagtgtgcaggactggtcggtcgcgctggcgagatgtgtgtagaaactttatgcgccggtaccaatcccgggtgactcagggtcttgtcgcaggcgagactgctcaacagatctgcgaggatcttcgactgtgcattccttcgaccggtcctctg

SEQ ID NO: 32829 - DNA, 435 bp, Artificial Sequence
  Description of Artificial Sequence: Synthetic coding sequence
atggcgacgtgggctttgctgctcctggcagcaatgctccttgggaacccaggactggtgttctctagactgagccctgagtactacgaccttgccagggcgcatctgcgggatgaagagaaaagctgtccctgcctggctcaagagggaccacagggagatctccttacaaagacacaggaattgggcagggactatcgcacttgcctcaccatcgtccagaaattgaaaaagatggttgacaaaccaacacagagaagtgtaagcaacgcagcgacaagggtatgtaggacagggagaagccgctggagggacgtttgcagaaactttatgagaaggtaccagagtcgagtcacgcaggggctggtggccggggagacggcgcaacaaatatgcgaagatctgcgcctgtgcattccaagtacaggtccactg

SEQ ID NO: 32830 - DNA, 435 bp, Artificial Sequence
  Description of Artificial Sequence: Synthetic coding sequence
atggcaacttgggccctgctgttactcgcggccatgctgttgggtaaccccggcctggtcttttccaggttgtcccccgaatattacgacctggctcgggcccacctacgggatgaggaaaaatcttgtccgtgcctcgcccaggaaggaccacagggagatctcctcaccaaaacccaggaactggggagagattataggacctgcctgacaatcgtgcaaaagctgaaaaagatggtcgacaaaccaacacagcggtcagtgagcaatgccgctaccagagtgtgcaggaccgggcggagccggtggagggacgtgtgcaggaactttatgagacgctatcagtcacgtgtcactcaggggctggtcgctggcgaaaccgctcaacagatatgcgaagacctcagactgtgtatcccctctacagggcccctg

SEQ ID NO: 32831 - DNA, 435 bp, Artificial Sequence
  Description of Artificial Sequence: Synthetic coding sequence
atggcaacctgggcgcttctccttctcgcagctatgctgctggggaaccctggcctggtgttttccaggttgagtcctgagtactatgatctcgcacgggcacatttgagagacgaggaaaagagctgtccctgtcttgcccaggaaggaccacagggtgaccttcttaccaagactcaagaactcgggcgcgactaccgcacctgccttacgattgttcagaaattgaaaaagatggtggataaaccgacccaacgatcagtctccaacgccgcaaccagagtgtgccgtaccggtcgttcaagatggagggatgtgtgtcgtaatttcatgcgccgctatcagtcaagagtgactcaaggactcgtcgccggtgaaactgctcagcaaatatgtgaagatctgcgtctttgcatcccatcgactggaccactg

SEQ ID NO: 32832 - DNA, 435 bp, Artificial Sequence
  Description of Artificial Sequence: Synthetic coding sequence
atggcaacttgggccctattgctgctcgctgcaatgctgttaggtaaccctggcttggtgttttccaggttgtccccagagtactacgatcttgccagagcacacctccgtgatgaagagaagagctgcccctgtctagcccaagaggggccgcagggtgaccttctaactaaaacacaagagttggggagggactataggacgtgcttgactatcgtgcagaagttgaaaaagatggttgataagcccacccagcgtagcgtgtcgaatgccgctacaagagtgtgtcggaccggaagatctaggtggcgagatgtgtgccggaatttcatgagaagatatcagtctcgtgtcactcaggggctggtagcgggcgaaacggctcagcaaatatgcgaggacctgcggctgtgcattccatctacggggcctctg

SEQ ID NO: 32833 - DNA, 435 bp, Artificial Sequence
  Description of Artificial Sequence: Synthetic coding sequence
atggccacttgggcccttctcctcctggcagccatgttgctggggaatcccggattggtctttagccgcctgtcccccgagtactatgacttggctcgcgcccacctccgagacgaggagaagtcatgcccttgcctggctcaggaggggcctcagggggatttgctgaccaagactcaggagttggggagggattacagaacgtgtcttacgatcgtgcagaagctgaagaaaatggtggacaagcctactcagaggagcgtgtcaaatgcagccactagggtgtgcaggaccggacgctcaaggtggagggatgtatgtagaaactttatgagaagatatcagtcacgcgtgacgcagggtttggtagctggtgagactgcacagcagatttgtgaggaccttcgactttgtattcccagtaccggtcctctt

SEQ ID NO: 32834 - DNA, 435 bp, Artificial Sequence
  Description of Artificial Sequence: Synthetic coding sequence
atggccacgtgggctctgctgctcctggccgcgatgctcctggggaacccgggtttggtgttcagcagattgtcgccagagtactacgacttggctcgcgctcatctgcgcgatgaggagaagtcctgcccctgtctcgcacaggagggaccacaaggagatctgctcactaagactcaggaactgggacgcgactaccgcacttgcctgactatcgtgcagaagttgaaaaagatggtggacaagcctacgcagcggagcgtctcgaacgcggccactagagtctgccggactggacgctcgcgctggcgggacgtgtgcagaaactttatgaggcggtaccagagccgcgtgacccagggcctggtcgccggagaaaccgcccaacagatttgcgaggacctgcgcctgtgtatcccgtcgactggacctctg

SEQ ID NO: 32835 - DNA, 435 bp, Artificial Sequence
  Description of Artificial Sequence: Synthetic coding sequence
atggccacttgggcgctgctgcttctggcagctatgctgctgggaaaccctgggctggtgttttcgcgcctgtcccctgagtactatgacctcgcccgcgctcatctgcgggacgaagagaaatcctgcccctgcttggcacaggaaggaccgcagggtgatcttctcaccaagacccaggaactcgggcgggactaccggacctgtcttaccatcgtccagaagctgaagaagatggttgacaagccgacgcaacgcagcgtgtcgaatgccgctacccgggtctgcagaactggacgctcacggtggcgcgacgtgtgtagaaactttatgagacgctaccaatccagagtcactcaggggctcgtggccggcgaaaccgcccagcagatttgcgaggacttgagactgtgcatcccttccaccggaccattg

SEQ ID NO: 32836 - DNA, 435 bp, Artificial Sequence
  Description of Artificial Sequence: Synthetic coding sequence
atggccacgtgggcgctgctgctcctggctgcgatgctgctgggaaaccccggtttggtcttttctcgcctgagccctgagtattatgatttggcccgagcgcatttgagggatgaagagaagtcctgtccttgcctggcgcaagagggaccccaaggtgatctcctaaccaagactcaggaactggggagggactaccgcacatgcctgactattgtgcagaaactgaagaagatggtcgacaagcctacacaacgtagcgtgtctaacgctgctacgcgggtctgtcggactggcaggtccagatggcgcgatgtctgcaggaactttatgcgccggtatcagtcccgtgtgacacagggccttgtggcaggagagacagcgcagcaaatctgcgaagacctgcggctgtgcatcccctcaactggacctctg

SEQ ID NO: 32837 - DNA, 435 bp, Artificial Sequence
  Description of Artificial Sequence: Synthetic coding sequence
atggcaacgtgggctctcctgctgctggcggccatgctgctgggcaatccggggctggtgttctcgcggctgtcgccggaatactatgacttggcaagggcgcacctccgcgacgaggagaagtcttgcccctgccttgctcaggaggggccacagggagatctgctgactaagacccaagaacttggtcgcgattacaggacctgtctgaccatcgtccaaaaactgaagaagatggttgataagcctacccagcgctcagtgtcgaacgcagctactcgcgtgtgtaggactggtagaagcaggtggcgggatgtgtgtagaaacttcatgcggagataccaaagccgagtgacccaggggctcgtggccggagagactgcccaacagatctgcgaggacctccggctctgcatcccgtcaacgggaccactc

SEQ ID NO: 32838 - DNA, 435 bp, Artificial Sequence
  Description of Artificial Sequence: Synthetic coding sequence
atggccacctgggccctgctgctgctcgccgctatgttgcttggaaaccctggactcgtgttcagcagactgtccccggaatactatgacctcgcgcgcgcgcatcttcgcgacgaagaaaaatcgtgcccatgcttggcccaagaggggccccaaggggacctcctcacgaaaacccaggaactgggcagagactacagaacttgcctgactatcgttcaaaaactcaaaaagatggtggacaagcccacccagagatccgtctccaatgctgccactagggtgtgccggaccggacgctcgcgctggcgggacgtgtgccgcaatttcatgcgccgctaccagtccagggtgacccagggactggtggccggcgagacggcccaacagatctgtgaggatctcagactgtgtatcccttccaccgggccactt

SEQ ID NO: 32839 - DNA, 435 bp, Artificial Sequence
  Description of Artificial Sequence: Synthetic coding sequence
atggccacctgggcacttctgctgttggcagccatgctgctaggaaatcctggtctcgttttctcccgcttatcccctgagtactacgatctggcccgtgcccacctgcgcgatgaggaaaaatcgtgcccgtgcctcgcacaagaaggtccccagggagatctgctgacaaaaactcaggagctgggtcgcgattatcggacatgcctcactattgtgcagaaactgaaaaagatggtcgataagccaacccaacgttcggtcagcaacgcggctacccgtgtgtgtcgcacgggtcgtagtcgctggcgcgatgtttgtaggaactttatgcgccgctatcagtcccgcgtcacgcaaggtctggtggcgggcgagacggcgcagcagatttgtgaggacctgcggttgtgcattcctagcacaggtccgtta

SEQ ID NO: 32840 - DNA, 435 bp, Artificial Sequence
  Description of Artificial Sequence: Synthetic coding sequence
atggctacctgggccctcttgcttcttgccgccatgttgctcggcaacccaggcctggtgttcagcaggctctcccccgagtactacgacctagctagggcccatctacgtgacgaagagaaaagctgcccttgtttggctcaagaaggtccacaaggcgatctgctgacaaagactcaggagttggggcgggactacagaacatgcctgacaatcgtgcaaaaactcaagaaaatggtggacaagcctacgcagcgatccgtgtctaatgcggccaccagggtgtgccggacagggcggagcagatggagggacgtgtgtaggaactttatgcgtcgctaccagagccgcgtgacccaaggattggttgcaggagagacggcacagcagatctgcgaggatctaagactgtgtatccctagcaccggcccactg

SEQ ID NO: 32841 - DNA, 435 bp, Artificial Sequence
  Description of Artificial Sequence: Synthetic coding sequence
atggccacatgggctttgcttctccttgccgctatgcttctggggaatccggggttggtgttctctagactatcgcctgagtactacgatctggcaagagcccacttgcgagatgaagagaaatcatgcccttgtctggcccaggagggtcctcagggtgatttactaaccaaaacccaggaactgggacgagactataggacttgtctgaccatagtgcagaaactgaaaaaaatggtggacaaaccgacgcagcgttccgtaagtaatgccgccactcgggtttgtaggaccggcagatccagatggcgggacgtctgcaggaatttcatgcggcgataccagtcccgggtgacccaaggtttggtagcgggagagactgcacagcagatatgcgaagacttgcggctctgtataccgagtaccgggcccctg

SEQ ID NO: 32842 - DNA, 435 bp, Artificial Sequence
  Description of Artificial Sequence: Synthetic coding sequence
atggcaacttgggcattgctgctgttggcagccatgctcctggggaatcctgggctggtgtttagccgtctgtcacccgaatactatgatcttgcacgggctcatcttcgcgatgaggaaaaatcctgtccttgcctggcgcaagaagggcctcagggcgatctgcttaccaagactcaagaacttggtcgagactacaggacttgcctgacgattgtgcagaagctgaagaagatggtggataaaccaactcaaagatcggttagcaatgcagcaacgcgagtctgtcgcactggacgatcaaggtggagagatgtttgtagaaactttatgaggcggtaccagagcagagtcacccaaggtttggtggcaggggaaactgcccaacagatttgcgaggatcttcgcctttgtatcccttctaccggtccactt

SEQ ID NO: 32843 - DNA, 435 bp, Artificial Sequence
  Description of Artificial Sequence: Synthetic coding sequence
atggcaacttgggctcttttacttcttgcagcaatgttactaggtaatccaggacttgttttcagtcgtttaagtccagaatattacgatttagcacgtgctcacttaagagatgaagaaaaatcgtgtccatgtttagctcaagaaggaccacaaggagatttattaactaagacacaagaactaggacgagattatagaacgtgtttaactattgttcaaaagttaaaaaagatggtagataaaccaacacaaagaagtgtaagtaatgctgctactcgtgtttgtcgaacaggaagatccagatggagagatgtttgtagaaactttatgagaagatatcaaagtcgtgttactcaaggacttgtagctggggaaacagcacaacaaatctgtgaagatttaaggctttgtattccatcaactggaccactt

SEQ ID NO: 32844 - DNA, 435 bp, Artificial Sequence
  Description of Artificial Sequence: Synthetic coding sequence
atggcgacttgggctctgctccttctggcagcgatgttgttgggtaatccgggcctggtgtttagccgcctctccccagaatactacgacctcgccagagcccatctgagggacgaggaaaagtcgtgcccctgcctggcccaggaaggaccccaaggagatctgctcactaagactcaggagcttggacgcgactaccggacctgcctgactatcgtccagaaactgaagaagatggtcgataaaccgacccagagatcggtgtccaacgctgcaacccgggtgtgtcggactggccgaagccgctggagagatgtgtgtcgcaacttcatgaggagataccagagccgcgtgacccagggactcgttgcaggggagactgcacaacagatctgcgaggatcttcgcctctgtataccgtccaccgggcccctg

SEQ ID NO: 32845 - DNA, 435 bp, Artificial Sequence
  Description of Artificial Sequence: Synthetic coding sequence
atggccacttgggcattactcctcctggcagccatgctgctcggtaacccaggactggtgttctctcggctgtccccagaatactacgaccttgcaagggcccatctgagagatgaagagaaaagctgtccatgtttagcccaggaaggcccgcagggggacctactaacgaaaacccaggagctgggtcgcgactatcgaacctgtctgaccatcgtccagaaactgaaaaaaatggtggacaaacccacacagaggtctgtcagtaatgccgctacacgtgtttgcagaaccggccgctcgagatggagggacgtgtgtagaaacttcatgcgtaggtaccagtcgagggttacgcagggcttggtcgcaggagaaactgcgcaacagatatgtgaggaccttagactgtgcattcccagcacgggtcccctc

SEQ ID NO: 32846 - DNA, 435 bp, Artificial Sequence
  Description of Artificial Sequence: Synthetic coding sequence
atggccacatgggctctccttctgctggctgccatgttgctaggcaacccaggcttggtcttctcccgactgagtcctgagtattatgatctggccagagctcacttaagggacgaagagaaatcatgcccctgcctagcccaggagggtccacaaggggacctgctaaccaagacccaggaactgggccgagattaccggacatgtctaacgatagttcagaagctgaagaaaatggtggacaagcccactcagcggtctgtctcgaacgcggccacacgcgtgtgtagaaccggtaggtctaggtggagagacgtgtgccgaaactttatgcggaggtatcagagccgtgttacgcagggcctcgtcgccggcgagaccgcacagcaaatttgtgaagacctaaggctttgtatcccatcaaccggacccctg

SEQ ID NO: 32847 - DNA, 435 bp, Artificial Sequence
  Description of Artificial Sequence: Synthetic coding sequence
atggctacctgggctctgcttctgctcgcagcaatgcttctcgggaatcctgggttagttttctctcgtttgagccccgagtactacgatttagccagagcacacctcagggacgaggagaagagttgtccttgcctcgcccaggaaggaccacagggagatctactcacaaagacccaggaactaggtcgcgactacagaacatgtttgaccattgtccaaaaacttaagaaaatggtagataagcccactcagaggtctgtttctaacgcggcaacacgagtgtgccgtaccggccggagtcgctggagggacgtgtgccgaaattttatgcgccgctatcagtctcgggtgacacaagggttggtggccggcgaaacagctcagcaaatctgtgaagatctccgactttgtatacccagcaccggcccactg

SEQ ID NO: 32848 - DNA, 435 bp, Artificial Sequence
  Description of Artificial Sequence: Synthetic coding sequence
atggctacttgggccctgctcctgctggccgccatgctactgggtaaccccggactggtcttttcccgacttagccccgaatattacgatcttgcccgggctcaccttcgggacgaggagaaatcctgcccatgccttgcccaggagggcccccagggcgatctattgactaagacacaggagttgggtagggactaccgcacttgcttgactatcgtccagaagctgaagaagatggtcgataagccgacacagaggtctgtttcaaatgccgccactcgagtgtgcagaacagggcgcagccggtggagagacgtctgcagaaatttcatgcggcgttaccaatctcgagtcacccagggattggtagcgggcgaaaccgctcaacagatttgtgaggatctcaggctgtgcatcccgtctactggaccgctg

SEQ ID NO: 32849 - DNA, 435 bp, Artificial Sequence
  Description of Artificial Sequence: Synthetic coding sequence
atggccacctgggcgctgttactgctggccgctatgttgctcggcaaccccggtctggtgttttcacgcctctcccctgagtactacgacttggccagagctcacttgcgggatgaggagaagtcctgcccgtgtctggcacaggaaggcccacaaggcgacctgttgacgaagacacaggagctgggccgagactatcgtacgtgcttgaccattgtgcagaaacttaaaaaaatggttgataaacctacacaaaggtctgtgagcaacgcggctactcgcgtgtgccgaaccggtagatcaaggtggcgagacgtgtgtcgtaactttatgaggaggtatcagtctcgtgttacacaaggacttgttgccggggaaaccgcacagcagatctgcgaggatttgagactctgtatcccgagcactggacctttg

SEQ ID NO: 32850 - DNA, 435 bp, Artificial Sequence
  Description of Artificial Sequence: Synthetic coding sequence
atggcaacctgggctctcctcctgttggccgctatgctgctgggaaaccccggcctcgttttctccagattgtccccggaatactacgacttggcccgcgcgcacctcagggatgaagagaagtcgtgcccgtgcctggctcaggaaggacctcagggggatcttctcactaaaactcaggaactgggcagggactatcggacttgtctcaccatcgtgcagaagttgaagaagatggtcgataaaccaacccaacgtagcgtgtccaatgcggcgacgcgcgtatgccgcaccggaagaagccgctggcgggacgtctgccggaactttatgcgtagataccagtcacgggtgacccaaggactggtggccggcgagactgcccagcaaatctgcgaggacctgcggctgtgcatcccgagtacgggaccgctg

SEQ ID NO: 32851 - DNA, 435 bp, Artificial Sequence
  Description of Artificial Sequence: Synthetic coding sequence
atggcgacttgggctctgctgctgctcgccgccatgcttctcggcaacccgggactcgttttctcgcgcctgtctccggaatactacgatctcgcacgcgcccacctgcgggacgaagagaaatcatgcccatgcctggcacaggaaggccctcagggcgatctgttgactaagactcaagagctgggacgggactacagaacttgcctcaccattgtccagaaattgaagaagatggtggataagccaacccagcggtccgtgtcgaatgctgccactagagtgtgccggaccgggaggtcgcgttggcgagacgtctgcagaaacttcatgcgacggtaccagagccgcgtgacccagggactcgtggcgggagaaaccgcacagcaaatctgcgaagatctccgcctgtgcatcccgtcgaccggcccactg

SEQ ID NO: 32852 - DNA, 435 bp, Artificial Sequence
  Description of Artificial Sequence: Synthetic coding sequence
atggcaacctgggcgctgctcctcctcgctgccatgctcctaggaaaccccggccttgtattcagtagattgagccctgagtattatgatcttgctcgggcccaccttcgcgacgaagagaaatcctgtccttgcctcgcccaggaagggccacagggagacttgctaactaaaacccaggagctggggagggactaccgcacatgtctcactattgtacagaagttaaagaaaatggtggataagccgactcagagaagtgttagtaacgcggcaacacgcgtgtgtaggaccgggagatcccgttggcgggatgtttgtcgaaattttatgagacgctatcagagccgagtgacacaaggcctggtcgctggggagaccgcccaacagatttgcgaagatttgcgtctttgtatcccctccactggaccactg

SEQ ID NO: 32853 - DNA, 435 bp, Artificial Sequence
  Description of Artificial Sequence: Synthetic coding sequence
atggcaacctgggcactgctgctgctcgcagcaatgttactggggaaccccggactggtgtttagtagactgagcccggaatattatgacctcgcccgtgcccaccttcgggacgaagaaaaatcttgtccctgcttggcacaagaagggccacagggagacctactgacaaaaactcaagaactgggccgggactacagaacatgcttgacaatcgtgcagaaactgaaaaaaatggtggataaacccacacaaagaagcgtcagtaatgccgctacacgagtctgtcgcacagggcgaagtcgctggagagacgtctgtagaaactttatgaggaggtaccagagcagagttacccaaggtctggtggcgggggagacagctcaacagatctgcgaggacttacgtctctgcattcctagcaccggcccctta

SEQ ID NO: 32854 - DNA, 435 bp, Artificial Sequence
  Description of Artificial Sequence: Synthetic coding sequence
atggctacttgggcccttctcttgctcgccgcaatgctcctggggaatccgggccttgtcttcagtcggctcagccctgagtactacgatctagcacgagctcatctgagagatgaagagaagtcatgcccttgccttgctcaagagggtccccagggcgacctgctcaccaaaacccaggagctgggtcgggattatcgcacctgtctgaccattgtccagaaactcaagaaaatggttgacaagcctacccagcgcagcgtgtctaacgcagccactcgggtgtgccggacaggacgctcgcggtggcgcgatgtatgtcggaacttcatgcgcagatatcagtcccgggttacgcagggactggtggcaggtgagacggcgcagcagatttgtgaagacttgagactatgtatccccagcactggcccactg

SEQ ID NO: 32855 - DNA, 435 bp, Artificial Sequence
  Description of Artificial Sequence: Synthetic coding sequence
atggccacctgggcactgctcttgctcgccgcgatgctcctggggaaccccgggctggtcttttcaagactgagcccagagtattacgatctggcaagggcccatctgagagatgaagagaagagctgcccatgcctggctcaagagggcccgcagggggacctgctcaccaaaacccaggaactgggacgggattaccgcacctgcctgaccatcgtgcagaaattgaagaagatggtggacaaacctacccagaggtccgtgtcgaatgccgcaacccgcgtgtgccggactggtagaagcagatggcgcgacgtgtgccgcaacttcatgcgccgctaccagtcccgcgtcacccagggactggtggccggggaaaccgcacaacaaatttgcgaggacctgcgcctctgcatcccgtcaactggtcctctg

SEQ ID NO: 32856 - DNA, 435 bp, Artificial Sequence
  Description of Artificial Sequence: Synthetic coding sequence
atggctacatgggctttgcttctacttgcggcaatgcttcttggaaaccccgggttagtcttttctcgtttatccccggagtattacgatttagcgcgtgctcatttgcgtgatgaagagaagtcttgcccgtgtttggctcaagaaggacctcaaggcgatctcttaacgaagacgcaagaattgggccgcgactatcgaacatgcttaacgattgtccaaaagttaaaaaagatggtcgacaagcctacacaaagatctgtcagtaatgcagcaacacgcgtttgcagaacggggcgttcgagatggcgcgacgtatgccgcaattttatgcgacgatatcagagccgggtaacccagggcctggtggcgggggagacagcccaacagatatgcgaagaccttcgcttgtgcatcccttccacaggacccctt

SEQ ID NO: 32857 - DNA, 435 bp, Artificial Sequence
  Description of Artificial Sequence: Synthetic coding sequence
atggctacatgggcactgctcctgctcgcagcgatgttgcttggtaatccaggcctggtttttagccgactgtcgccggagtattatgatctggcccgtgcccatttacgagacgaagaaaaatcttgtccgtgtttggctcaggaaggcccacagggagacttacttaccaagactcaagaactaggacgagattataggacttgcctcacaatagttcaaaaacttaagaaaatggtcgataaacctacgcagcgttcagtttccaatgcagcgacacgtgtttgtagaaccggacggtctcgttggcgcgatgtatgccgtaatttcatgagaagatatcagagcagggtgacacagggtctggttgcaggtgagacggctcaacagatctgcgaggatctgcgtctgtgcatcccgtctacaggaccactt

SEQ ID NO: 32858 - DNA, 435 bp, Artificial Sequence
  Description of Artificial Sequence: Synthetic coding sequence
atggctacctgggcgcttctgcttctggccgcaatgttgctggggaaccctggtctggtatttagtcggctgtcgccagaatactacgaccttgcccgggctcacctgcgcgatgaggagaagtcctgtccctgcctggctcaggagggcccgcagggcgacctcctgaccaagactcaggaacttggaagggattatagaacctgtcttactattgtgcaaaaacttaagaaaatggtggataagcccacgcaaagatctgtgtccaatgcagccaccagggtgtgccgaactggcagaagccggtggcgtgacgtctgtagaaacttcatgcgcaggtaccagagcagagtcacccaaggacttgtcgcaggcgaaactgcacaacagatctgcgaagatctgcgcctgtgtataccttcaaccggacctctc

SEQ ID NO: 32859 - DNA, 435 bp, Artificial Sequence
  Description of Artificial Sequence: Synthetic coding sequence
atggccacctgggccctgctgttgctggccgctatgctcttggggaacccgggactggtgttctcccggctgtcgcccgaatactatgatcttgcgagagcacacttgcgagacgaagagaagtcgtgcccatgccttgcgcaggaaggaccgcaaggtgacctgctcaccaagacccaggagctggggagggactaccgcacctgcttgactatcgtccagaaactgaagaaaatggtagataagcctacccaacggagcgtctcaaacgccgcgactcgagtatgcagaaccggcagatctcgctggcgcgacgtgtgtcggaatttcatgcggcgataccaatcacgcgtgactcaaggactggtggcgggggagacggcccagcagatctgtgaagatctccgtctgtgcattccgtcgactggacctctc

SEQ ID NO: 32860 - DNA, 435 bp, Artificial Sequence
  Description of Artificial Sequence: Synthetic coding sequence
atggcaacgtgggcacttttgttgctcgcagcaatgctcctcggaaacccaggtcttgtcttttcccgcctttcacctgaatactatgacctggcgcgcgcccatctgcgcgacgaagagaaatcgtgcccgtgtcttgcacaagaaggacctcaaggcgatctcctgactaagacccaagaacttgggagggactaccgcacctgtctgactatagttcaaaagctgaaaaagatggtcgataagcccacccaaagatctgtgtcgaacgccgcaactagggtctgtcgaaccgggaggagcagatggcgggatgtctgtagaaatttcatgaggaggtaccagagtcgtgtgactcaaggtttggtggcgggggaaacggcgcagcagatttgtgaagatttgaggctttgcattccatccaccggtcctctg

SEQ ID NO: 32861 - DNA, 435 bp, Artificial Sequence
  Description of Artificial Sequence: Synthetic coding sequence
atggcaacctgggcactgctgctgctggcagccatgcttctgggaaacccaggtctggtgttttcacgtcttagccccgaatactacgatttggcaagagcacacctgagggatgaagaaaagtcgtgcccatgtctcgcacaagaaggaccccaaggtgacctgctcactaagacccaagaacttgggagggactaccgcacgtgtcttacgattgtccagaagctgaagaagatggtggacaaacccactcaacggtcggtgtccaacgccgcaactagagtgtgcaggaccggaaggtcgaggtggcgagacgtgtgtagaaacttcatgcggagataccaatcgcgggtcacccaaggactggtggcgggagaaactgcgcagcaaatatgtgaggatcttagactctgcattccttccaccggtccactt

SEQ ID NO: 32862 - DNA, 435 bp, Artificial Sequence
  Description of Artificial Sequence: Synthetic coding sequence
atggcaacctgggcattgctccttcttgcagcaatgcttcttggaaatcccggcctggttttttcccgactgtcccctgaatactacgatctggcacgagcacatttgagggatgaagaaaagtcttgtccatgccttgcgcaggagggtcctcagggcgatctcctgactaagacccaagaactggggcgggattaccgtacttgtctgaccatcgtgcaaaagctcaaaaagatggtcgataagccaactcaacgcagcgtgtccaatgcagccacgcgcgtgtgtcgcaccgggcgcagcaggtggagggatgtgtgccgtaactttatgagaagataccagtctcgtgtgactcaaggacttgtcgccggcgaaaccgcgcaacaaatatgtgaagatctccggctttgtattccgtcgactggacctctt

SEQ ID NO: 32863 - DNA, 435 bp, Artificial Sequence
  Description of Artificial Sequence: Synthetic coding sequence
atggcgacatgggcccttctgttattggcggctatgctcctcggcaatcccggcctggtcttttcaaggttgtccccagaatactatgacttggcacgcgctcacttgcgggatgaggaaaagtcatgcccttgcttggcccaggagggtcctcagggcgacttgctaaccaaaacgcaagaactcggccgagattacaggacgtgtcttactatcgttcagaagctgaaaaaaatggtggacaagccgacacagcgatcagtttccaatgcggcaactcgggtgtgccgtacaggcagaagtcgctggcgagacgtgtgcagaaactttatgagaagataccagtccagagtcactcaaggactcgtcgctggcgagacagcccagcagatatgtgaggatctgcggctgtgcataccatccactggccccctg

SEQ ID NO: 32864 - DNA, 435 bp, Artificial Sequence
  Description of Artificial Sequence: Synthetic coding sequence
atggctacctgggcactattgctgttggcagctatgctgcttggtaaccccggcctggtattctcccgcctgagccccgaatactatgacctggcccgcgctcacctgagggatgaggagaagtcttgtccttgtctggcccaggagggcccccagggcgatttgctcaccaagacccaagagcttggccgcgactaccgcacctgcctgacgattgtccagaagctcaagaaaatggtagacaagcccacccaacgctccgtcagcaacgccgctacccgggtgtgtcgcacgggacgctcccgttggcgggatgtctgcaggaacttcatgcgtcgttaccagagccgagtcacccaaggtctggtggccggagagaccgcccagcagatatgtgaagatctccgcctgtgcatcccctcgaccggtccgctg

SEQ ID NO: 32865 - DNA, 435 bp, Artificial Sequence
  Description of Artificial Sequence: Synthetic coding sequence
atggccacttgggcactcctgctgcttgctgccatgctgcttggtaatccgggcctggtgttttcacgactcagccccgaatactacgatctggctagagcacatctccgcgacgaggaaaaatcctgcccatgtctggcacaggagggacctcaaggagatttgctcacgaaaacccaggagttgggtagagattataggacttgtctcactattgttcaaaaacttaagaaaatggtcgataagccgactcaacgttcagtttcgaacgcagcgacgagggtgtgtagaacgggaagatcccgctggcgagacgtgtgtaggaacttcatgagaagatatcagtcacgggtgacccaaggattggtcgcaggtgaaaccgcccaacagatctgcgaggatcttcggctgtgtattccctcgactgggcccctc

SEQ ID NO: 32866 - DNA, 435 bp, Artificial Sequence
  Description of Artificial Sequence: Synthetic coding sequence
atggcaacctgggcactgttgcttctggccgctatgttgcttggaaacccgggactggtgttctcccgcttgtcaccagagtactatgatcttgcacgcgcacatttgcgtgacgaggaaaagtcgtgcccgtgtctcgcacaagaaggaccacaaggcgatctgcttaccaaaactcaggagcttggtagagactaccggacctgtctgactattgtgcaaaaacttaagaagatggtcgataagccaacccagaggagcgtgtccaacgccgcgactcgcgtgtgtaggactggtcggagccgctggagagatgtgtgtagaaactttatgagacgttatcaatcgcgggtgactcagggtcttgttgctggcgaaaccgcccagcagatttgcgaagatctgcgtctttgtattccttccaccggtcccctg

SEQ ID NO: 32867 - DNA, 435 bp, Artificial Sequence
  Description of Artificial Sequence: Synthetic coding sequence
atggcgacgtgggcgttactattattagcggcgatgctattaggtaatccgggtttagttttttcgcgtctatcgccggaatattatgatctagcgcgagcgcatttacgagatgaagaaaaatcgtgtccgtgtctagcgcaagaaggtccgcaaggtgatttactaacgaaaacgcaagaattaggtcgtgattatcgaacgtgtttaacgatagtacaaaaattaaaaaaaatggtagataaaccgacgcaacgttcggtttcgaatgcggcgacgcgtgtttgtcgaacgggtcgttcgcgttggcgtgatgtttgtcgaaattttatgcgtcgttatcaatcgcgtgtaacgcaaggtttagtagcgggtgaaacggcgcaacaaatatgtgaagatttacgtttatgtataccgtcgacgggtccgtta

SEQ ID NO: 32868 - DNA, 435 bp, Artificial Sequence
  Description of Artificial Sequence: Synthetic coding sequence
atggcaacctgggctcttctgctgctggccgctatgctgttaggaaacccaggactggtgttctccagactcagccctgagtactatgacctggcaagagctcatctacgcgacgaagagaaaagttgtccatgtctggcacaggaaggcccacagggcgaccttctcacaaaaactcaagagctaggacgcgattacaggacctgcttgacgatcgtgcaaaagctgaagaagatggtcgataagccgactcagcggtctgtgagcaatgctgccacgagagtgtgtaggactggcagaagtcgatggcgggacgtatgcagaaacttcatgcggaggtaccaaagtcgagtcacccagggcctagtggccggtgagactgcacagcaaatatgtgaagatctgcgactttgtattcccagcactggtccactg

SEQ ID NO: 32869 - DNA, 435 bp, Artificial Sequence
  Description of Artificial Sequence: Synthetic coding sequence
atggccacctgggcgctcctgctgctggctgccatgctgctcggaaatccaggactcgtgttttctcggctgtcgcctgaatactatgatctggcaagagcgcacttgcgggacgaggaaaagagctgcccttgtctcgcacaagagggcccgcaaggggaccttttgactaaaacccaagaactgggacgggattaccggacctgtctcactatcgtgcagaagctgaagaagatggtcgacaaacctactcagcgctccgtgtcgaatgccgccacccgcgtctgtaggactggcagatcccgctggcgcgacgtgtgccgcaatttcatgagacggtaccagagccgcgtgactcagggcctggtggcaggggaaactgcgcagcaaatctgcgaagatctgcggctgtgcatcccgtccacgggtccactg

SEQ ID NO: 32870 - DNA, 435 bp, Artificial Sequence
  Description of Artificial Sequence: Synthetic coding sequence
atggctacgtgggccctgctacttctagcagcgatgttgctgggtaacccgggccttgtgttcagccgcttatcccctgagtactatgacttggcccgcgcccatttgagggatgaggagaaaagttgtccttgtctggcccaggagggtccccaaggtgacctactgaccaaaactcaggaattaggtcgggattatcggacctgcctcactattgtccagaagctgaagaagatggtggacaaacctacacagagatccgtgagtaatgctgcaacgagagtatgtcggaccggtaggagccgctggagggacgtgtgtagaaactttatgagacgctatcagtcccgcgtcacgcaggggctggtggcgggggaaacggcccagcagatctgtgaggacctgcgtctttgtattccatccactggtcctctt

SEQ ID NO: 32871 - DNA, 435 bp, Artificial Sequence
  Description of Artificial Sequence: Synthetic coding sequence
atggccacttgggcattgctcctgctcgccgccatgcttttgggcaatccaggactcgtgttttctagactgagcccagagtactacgatctggctagggcacacctgcgcgacgaagagaaaagctgtccctgcctcgcgcaggagggcccccaaggcgatctcttaaccaagactcaggagctcgggcgagattataggacatgcttgactatcgtccaaaaattgaagaaaatggttgacaagcccacacagcgaagcgtatcaaacgctgcgaccagagtgtgtaggacaggccgttcacgatggcgcgacgtatgtaggaacttcatgaggcgataccagtctagagtcactcaggggcttgtcgcgggtgaaaccgctcagcagatctgtgaagatctgcgactgtgcatacccagcaccggccccctg

SEQ ID NO: 32872 - DNA, 435 bp, Artificial Sequence
  Description of Artificial Sequence: Synthetic coding sequence
atggccacatgggccctgctgctgttagctgccatgctccttggaaaccccggactggtgttctcaaggctgagtccagaatattatgatctggccagagcacatctgagggatgaggaaaaatcttgcccatgcctagctcaagaagggccccagggggatctactgacgaaaacacaggaactcggaagagattataggacttgtctcactatcgtgcagaaactgaaaaaaatggtggacaaacccacacagcggtctgtcagtaacgccgcgacacgcgtctgccggactggaaggtctcgctggagagatgtatgcagaaacttcatgaggcggtatcagagtagggtgactcaggggttggtggccggagaaacagcccagcagatctgtgaagatctccggctatgcatcccaagtactgggcctcta

SEQ ID NO: 32873 - DNA, 435 bp, Artificial Sequence
  Description of Artificial Sequence: Synthetic coding sequence
atggctacatgggccctactgctgctcgccgctatgctcctagggaatcccggcctggtgttttctcggttaagccccgagtattatgatttagcccgggcccatctgcgtgacgaagaaaaaagctgtccatgtctggcccaggagggaccacagggcgatctgctgacaaagacacaggagcttgggagggattaccggacttgcttgaccatagtgcaaaagttaaaaaaaatggtggacaaaccaactcagaggtcagtgagcaatgccgctaccagagtttgtaggacaggcagatccaggtggagagacgtttgccgcaatttcatgcgcaggtaccagagccgagtgacccagggcctggtggcaggtgaaacagctcagcagatttgtgaggacctcagactatgcatcccatcaacagggccactc

SEQ ID NO: 32874 - DNA, 435 bp, Artificial Sequence
  Description of Artificial Sequence: Synthetic coding sequence
atggcgacgtgggccttgcttcttcttgccgcaatgctgcttggtaatccaggactggtgttcagtagattgtcacctgaatactatgacttggctcgggcccacttgagggatgaggagaaatcgtgcccctgccttgctcaggagggtccacaaggtgatctgctcacaaaaacccaggaattagggagggattacagaacttgccttaccatagtgcagaagctaaagaagatggtcgataagcctacacagaggagtgtgtcgaacgctgccactagggtttgtcgcaccggtcgaagcaggtggcgtgatgtttgtcgtaatttcatgcggaggtatcaatctcgagttacgcaaggactggttgctggtgaaactgcacaacagatttgcgaagacctgagattgtgtatcccatctacaggtcccctc

SEQ ID NO: 32875 - DNA, 435 bp, Artificial Sequence
  Description of Artificial Sequence: Synthetic coding sequence
atggccacttgggcccttctcctcttggcggctatgttgctcggaaatcctggcctcgtgttttctcgactttcgcctgagtactacgacctggcccgggcccaccttagagatgaagaaaaatcatgcccatgtctcgcacaggagggcccgcagggcgacctgctgactaaaacgcaggaactgggacgagattacagaacctgcctcaccatcgtccagaagctgaagaagatggtggacaagcccacccagcggtctgttagtaacgcggctacgcgcgtgtgccgtaccgggcgcagcaggtggcgcgatgtgtgccgcaacttcatgcggagatatcaatcccgagtcacgcagggcctggtggccggagaaaccgcgcaacaaatctgcgaggacctgcgcttgtgtattccgtcaaccggtccgctg

SEQ ID NO: 32876 - DNA, 225 bp, Artificial Sequence
  Description of Artificial Sequence: Synthetic coding sequence
atgggccgagattacaggacctgcctgacaattgtgcagaagttaaagaaaatggtggataagcctactcagcgcagcgtctcaaatgccgccaccagggtctgcagaactgggagatcaaggtggcgagatgtgtgccgtaactttatgcgtcgatatcagtctcgagtgactcagggcctcgttgccggggagactgcccaacagatatgtgaagatctaaga

SEQ ID NO: 32877 - DNA, 225 bp, Artificial Sequence
  Description of Artificial Sequence: Synthetic coding sequence
atgggtcgggattaccgcacctgcctgaccatcgtgcaaaagctgaaaaagatggtggacaagcctacccagcgcagcgtgtcaaacgccgcgacccgcgtgtgtaggacgggacgatcgagatggagagatgtgtgtagaaacttcatgaggcggtaccagtcaagagtgactcagggattggtcgcaggtgagactgcgcaacagatctgcgaagatctccga

SEQ ID NO: 32878 - DNA, 225 bp, Artificial Sequence
  Description of Artificial Sequence: Synthetic coding sequence
atgggacgggactacagaacgtgcctgaccatcgtgcagaagctcaaaaagatggttgataagccgacgcaaaggagcgtgtcaaatgccgcgaccagagtgtgtcgcaccggtcgttcgcgatggagggatgtctgcagaaacttcatgcgccgataccaatcccgggtgactcagggactggtagcgggcgaaactgcacagcagatctgcgaggaccttaga

SEQ ID NO: 32879 - DNA, 225 bp, Artificial Sequence
  Description of Artificial Sequence: Synthetic coding sequence
atggggcgcgactaccgcacttgtctcaccatcgtgcagaaactcaagaaaatggtggacaagccgacccagcggtcggtgtcaaacgccgccacccgcgtctgtcgcactggtcgctcccgctggcgcgacgtgtgccgtaatttcatgcggagataccagtcgagggtcactcaaggactggtggcgggtgagactgcgcagcagatctgcgaggatttgcgc

SEQ ID NO: 32880 - DNA, 225 bp, Artificial Sequence
  Description of Artificial Sequence: Synthetic coding sequence
atggggcgcgactaccggacctgcttgactattgtgcagaagttgaagaaaatggtggataagcctacccaacgctccgtctccaacgcagccactcgcgtgtgtcgcaccggacgttcaagatggcgggatgtctgtaggaactttatgcggcgataccagtccagagtgacccaaggtcttgtggcaggagagactgcccagcagatttgcgaggatctcagg

SEQ ID NO: 32881 - DNA, 225 bp, Artificial Sequence
  Description of Artificial Sequence: Synthetic coding sequence
atgggccgggattataggacatgtctcaccatcgtgcagaaactgaagaaaatggttgacaagcccacgcagcgcagtgtatcaaacgccgcaacaagagtctgtcggacaggacgaagtagatggagggatgtgtgccggaacttcatgcgtcgataccaatctagagtgacccaggggttggtggccggcgaaacggcccagcagatttgcgaggacttgaga

SEQ ID NO: 32882 - DNA, 225 bp, Artificial Sequence
  Description of Artificial Sequence: Synthetic coding sequence
atggggcgggattaccggacctgtctgaccatcgtgcaaaaacttaagaagatggtggataagcctacgcaaagatcagtttccaatgcggcaacccgcgtgtgtcggactggcagaagcagatggagagatgtctgccggaactttatgagacggtaccagtcacgggtgactcagggactcgtcgcaggtgagactgcacaacagatttgtgaagatctgaga

SEQ ID NO: 32883 - DNA, 225 bp, Artificial Sequence
  Description of Artificial Sequence: Synthetic coding sequence
atgggaagagactaccggacctgccttacgatcgtgcagaagctgaaaaagatggtggataagcccactcagagaagcgtctccaacgcagcgacgcgggtgtgccgcaccggacgatcgcgctggagagacgtctgccgcaatttcatgagacggtaccaatcacgggtcactcagggactggtggccggagagactgcccagcagatctgcgaagacctccgg

SEQ ID NO: 32884 - DNA, 225 bp, Artificial Sequence
  Description of Artificial Sequence: Synthetic coding sequence
atgggcagagactatcgtacttgccttacaatcgtgcaaaagctgaagaaaatggtggataagcccactcaaagatccgtctcaaacgcagctaccagggtctgccgcaccggcagatctagatggagggatgtctgtaggaatttcatgagacgttaccagtctagagtgacccagggtctcgtggccggtgagaccgctcaacagatctgtgaagaccttaga

SEQ ID NO: 32885 - DNA, 225 bp, Artificial Sequence
  Description of Artificial Sequence: Synthetic coding sequence
atgggcagagattaccggacctgcttgactattgttcagaagttgaagaagatggtagataaacctacccagcgtagcgtgtcaaacgccgctactcgcgtctgcagaaccggccggtctcggtggcgggacgtttgcagaaacttcatgagacggtatcaatctagggtcactcagggtttggtggcgggcgagactgcccagcagatctgcgaagatttgagg

SEQ ID NO: 32886 - DNA, 225 bp, Artificial Sequence
  Description of Artificial Sequence: Synthetic coding sequence
atggggcgagattataggacatgcctgactatcgtccagaagctgaaaaagatggtggataaacccacacagcgtagtgtcagtaacgctgcaacacgggtgtgtcgcaccggccgttctaggtggcgggacgtgtgcagaaactttatgcggaggtaccagtctcgcgttacccagggtctcgtggctggcgaaaccgctcaacaaatctgcgaggacctgagg

SEQ ID NO: 32887 - DNA, 225 bp, Artificial Sequence
  Description of Artificial Sequence: Synthetic coding sequence
atgggaagagactacagaacctgccttaccatcgtgcaaaaactgaagaagatggtggacaagccgacccagcggtcggttagcaacgctgccactcgggtgtgcaggactgggcgctcccgatggcgcgacgtgtgcaggaatttcatgagacggtaccagtcccgggtcacgcagggattggtggccggagagactgcacagcagatttgtgaggatctgaga

SEQ ID NO: 32888 - DNA, 225 bp, Artificial Sequence
  Description of Artificial Sequence: Synthetic coding sequence
atgggacgagattatagaacctgcctgaccatagtgcagaagctgaagaagatggttgataagcctacccagcgaagtgtctctaacgccgccacccgcgtgtgtcggaccgggcggtccagatggcgggatgtgtgccgcaactttatgcgacgatatcagtccagagtcacccagggtctcgtcgctggcgaaacagctcagcagatctgtgaagacctgcgc

SEQ ID NO: 32889 - DNA, 225 bp, Artificial Sequence
  Description of Artificial Sequence: Synthetic coding sequence
atggggcgagactatcgaacctgtttgacaattgttcagaagctcaagaaaatggttgataagcccactcaaaggtctgtctccaacgcggctacccgggtgtgtcgcacgggtaggtcacgatggagagacgtgtgtcgcaattttatgcggcgctatcagtcaagggtaactcaagggctggtggcaggcgagaccgcacaacagatctgcgaggacttgcgg

SEQ ID NO: 32890 - DNA, 225 bp, Artificial Sequence
  Description of Artificial Sequence: Synthetic coding sequence
atgggaagagattaccgcacctgtcttactatcgtgcagaaactcaaaaagatggtggataaaccaacccaacgctcggtgtcaaacgcagcaacccgcgtgtgccggactgggagaagccgatggcgggatgtgtgtcgcaatttcatgcgtcggtaccagagccgtgtgacgcagggcctggtggctggcgagactgcacagcaaatttgtgaagatctgaga

SEQ ID NO: 32891 - DNA, 225 bp, Artificial Sequence
  Description of Artificial Sequence: Synthetic coding sequence
atgggccgggattaccggacctgcctcactatcgtgcagaagctcaagaagatggtcgacaagcccacccaacgctcggtgtcaaacgccgcaacgcgcgtgtgcaggaccggccgcagcaggtggcgcgatgtctgccggaacttcatgcgccgctaccagtcgcgggtgacccaaggactggtcgccggggaaactgcgcaacagatctgcgaggacctcagg

SEQ ID NO: 32892 - DNA, 225 bp, Artificial Sequence
  Description of Artificial Sequence: Synthetic coding sequence
atgggacgggactatcgcacttgtcttactatagttcagaaactcaagaagatggtcgacaagcccacacaacggtctgtgtccaatgcggctactagggtgtgcaggacagggaggagtcggtggcgcgatgtgtgtcggaactttatgcggaggtaccagtcacgcgttacacaagggctagtcgcgggggaaacagcccagcagatatgtgaggatctccgg

SEQ ID NO: 32893 - DNA, 225 bp, Artificial Sequence
  Description of Artificial Sequence: Synthetic coding sequence
atgggtcgtgattatcgtacgtgtctaacgatagtacaaaaactaaaaaaaatggttgataaaccgacgcaacgatcggtatcgaatgcggcgacgcgagtatgtcgaacgggtcgatcgcgttggcgtgatgtttgtcgaaattttatgcgacgttatcaatcgcgtgttacgcaaggtttagtagcgggtgaaacggcgcaacaaatatgtgaagatttacgt

SEQ ID NO: 32894 - DNA, 225 bp, Artificial Sequence
  Description of Artificial Sequence: Synthetic coding sequence
atgggacgggactaccgcacttgtctgaccattgtgcaaaaactgaagaagatggtcgacaagccgactcagcggagcgtttcaaacgcagctacgagggtttgtcgaactggtagatcgcggtggcgcgacgtgtgccggaatttcatgagacgttaccaaagcagagtcacccagggacttgtggcgggcgaaacggcccagcagatctgcgaggatctccgg

SEQ ID NO: 32895 - DNA, 225 bp, Artificial Sequence
  Description of Artificial Sequence: Synthetic coding sequence
atgggacgagattatcggacgtgcttaactatagtccaaaaacttaagaagatggtcgacaagcctacacagcgctccgtgagtaatgctgcgaccagagtgtgtcggacggggcggagcaggtggcgggatgtttgccggaacttcatgaggcgttatcagtcacgggtgacccagggactggtggcaggagaaaccgcgcagcagatctgtgaggatctccgg

SEQ ID NO: 32896 - DNA, 225 bp, Artificial Sequence
  Description of Artificial Sequence: Synthetic coding sequence
atgggccgtgactaccgcacatgtcttaccatcgtgcagaaacttaaaaagatggtggataagcctacacagcggtccgtgagtaacgcagctacacgcgtctgtagaacgggccggtctaggtggcgtgatgtctgccgcaattttatgagaagataccagagtcgcgtgacgcaggggttagtggcaggagagacagcccagcagatatgcgaagatctccgg

SEQ ID NO: 32897 - DNA, 225 bp, Artificial Sequence
  Description of Artificial Sequence: Synthetic coding sequence
atggggcgagactaccgaacgtgcctgactattgtgcaaaagttgaagaagatggtggataagccaactcagcggtcggtgagcaacgccgcaactcgcgtgtgcagaaccggcagatcccgctggcgtgatgtctgtagaaacttcatgcggaggtaccagagcagagtgacccaaggactggtggcgggagaaaccgctcaacagatttgtgaggatttgcgt

SEQ ID NO: 32898 - DNA, 225 bp, Artificial Sequence
  Description of Artificial Sequence: Synthetic coding sequence
atggggcgcgattaccggacatgtctgactatagttcagaagctgaaaaagatggtggataagccaactcagagatcggtgtctaatgctgccactcgcgtgtgtaggacaggaaggtctagatggcgcgatgtgtgtcgaaatttcatgagaagataccagtcaagggtaacgcagggactggttgccggggagacagctcagcagatctgtgaggacctgcgc

SEQ ID NO: 32899 - DNA, 225 bp, Artificial Sequence
  Description of Artificial Sequence: Synthetic coding sequence
atgggaagagattaccggacctgtttgactatcgtccagaagttgaagaaaatggttgataagcctactcagcgctctgtatcgaacgccgctacaagagtctgccggaccgggagaagccggtggcgggatgtgtgtcgcaactttatgaggagataccagtcccgggtgacccagggactggtcgctggagaaaccgcccaacagatctgtgaagatttgaga

SEQ ID NO: 32900 - DNA, 225 bp, Artificial Sequence
  Description of Artificial Sequence: Synthetic coding sequence
atgggaagggattatcgaacgtgcttgacaatagttcagaagctgaaaaaaatggtggacaagccgacccagagaagtgtgagcaatgccgcaactcgcgtgtgcaggacaggtaggtcaaggtggagggatgtgtgccggaacttcatgcgcagatatcagagccgcgtgactcagggcttggtggccggtgagaccgcacaacaaatctgcgaggacctgagg

SEQ ID NO: 32901 - DNA, 225 bp, Artificial Sequence
  Description of Artificial Sequence: Synthetic coding sequence
atgggtagggattataggacatgtttgaccatcgtccaaaagttgaagaagatggtagacaagccaacacaaagaagtgtctccaacgccgctacacgcgtttgccgcacaggccgcagtagatggagagacgtgtgtaggaatttcatgcgcagataccaatcaagagttacgcaaggcctggtggctggagaaactgcgcagcagatctgcgaagatttgagg

SEQ ID NO: 32902 - DNA, 225 bp, Artificial Sequence
  Description of Artificial Sequence: Synthetic coding sequence
atgggacgggattacaggacctgtcttaccatcgtccagaagctaaagaagatggttgataaaccaactcagcggagtgtaagtaacgcggctacacgggtgtgcaggactggccgctctcggtggcgggatgtatgtagaaactttatgagacgttatcagtccagagtgactcaaggacttgtagcgggtgaaaccgctcagcaaatatgcgaagatctaagg

SEQ ID NO: 32903 - DNA, 225 bp, Artificial Sequence
  Description of Artificial Sequence: Synthetic coding sequence
atgggtcgcgattacaggacgtgcctcacgatagttcagaagttgaaaaagatggtggacaagcctacccaacgatcagtctcaaatgccgcaacccgcgtgtgtagaactggtagatcccggtggcgagatgtgtgtcggaactttatgaggagataccaatcccgggtgactcagggactggtggcaggagagactgcacaacaaatatgtgaagatcttagg

SEQ ID NO: 32904 - DNA, 225 bp, Artificial Sequence; identical to SEQ ID NO: 32881
  Description of Artificial Sequence: Synthetic coding sequence

SEQ ID NO: 32905 - DNA, 225 bp, Artificial Sequence
  Description of Artificial Sequence: Synthetic coding sequence
atgggtagggattatcgaacctgtttgactatcgtccagaagctcaagaaaatggtggacaaaccaacacaacgatccgtgagcaatgccgctacgcgtgtatgcaggacgggccgatcccgatggcgcgatgtatgtagaaatttcatgcggcgataccagagtcgagttacacaaggcctggtggctggtgaaaccgcgcagcagatctgtgaagaccttcga

SEQ ID NO: 32906 - DNA, 225 bp, Artificial Sequence
  Description of Artificial Sequence: Synthetic coding sequence
atgggacgggactatcgtacttgcctgactattgtccagaaactgaagaagatggttgacaagcccactcaacggtccgtctctaacgcggcaacacgggtgtgccgaactgggcgttcacgctggcgggacgtgtgtcgtaattttatgcgtcgctatcagagtagggtgacccagggcctcgtcgccggagaaactgcgcagcagatatgtgaagacctgaga

SEQ ID NO: 32907 - DNA, 225 bp, Artificial Sequence
  Description of Artificial Sequence: Synthetic coding sequence
atgggtcgggattaccgcacttgcttgacgatcgtgcagaagctgaaaaagatggtggataagccgacccaacggtccgtatcgaatgctgcaactcgggtttgtaggaccggcagatcgaggtggcgggacgtctgcagaaacttcatgcgaaggtaccagagcagggtgacccaggggcttgtcgccggagaaacggcgcagcaaatctgcgaggacctcagg

SEQ ID NO: 32908 - DNA, 225 bp, Artificial Sequence
  Description of Artificial Sequence: Synthetic coding sequence
atgggtagagactacagaacgtgcttgactatcgtgcaaaaactcaagaagatggtagataagccgacccagcgatcagtttctaatgcagcgaccagggtgtgtcggaccggacgctcgcggtggcgcgacgtgtgccgtaacttcatgcgtaggtaccagtcccgggtcactcaggggctggtggctggcgaaaccgcccaacagatctgcgaggaccttcgc

SEQ ID NO: 32909 - DNA, 225 bp, Artificial Sequence
  Description of Artificial Sequence: Synthetic coding sequence
atgggccgcgattatcgaacatgcctcacgattgtacaaaagctcaagaaaatggttgataaaccaacgcagcgaagcgtgagcaacgcggcaacacgggtgtgtcgaaccggtagaagccgttggcgggatgtgtgtcgcaacttcatgcgccgttatcaaagccgtgtgacccagggcttagtggcaggggagacggcccagcagatttgcgaggacctcaga

SEQ ID NO: 32910 - DNA, 225 bp, Artificial Sequence
  Description of Artificial Sequence: Synthetic coding sequence
atgggacgggattatcgcacttgcctgaccatagtgcagaaacttaagaagatggtggacaagcctactcaaaggagcgtctcgaacgctgcaactcgagtgtgtcggaccgggcgtagcaggtggcgggatgtgtgtcgcaactttatgcgaaggtaccagtccagagtcactcaaggactggtcgcgggggaaaccgcacaacagatttgtgaggatctgcgt

SEQ ID NO: 32911 - DNA, 225 bp, Artificial Sequence
  Description of Artificial Sequence: Synthetic coding sequence
atgggccgggactacagaacttgcctgaccatcgtgcagaaactcaagaagatggtggataaaccgactcagcgctcggtgagcaacgccgcgacccgcgtctgcaggactggccggagcaggtggagagacgtgtgtcgcaatttcatgcgccggtaccaatcccgcgtgacgcagggactggtggccggggagactgcccagcagatttgcgaagatctcaga

SEQ ID NO: 32912 - DNA, 225 bp, Artificial Sequence
  Description of Artificial Sequence: Synthetic coding sequence
atgggaagggactatcgtacttgtctgacgatcgtacagaaactcaaaaagatggtcgataaaccaacacaacggagcgtgtctaatgccgctactcgcgtgtgtcggactggcagaagtcggtggagagatgtctgtcggaattttatgcgtcggtatcagtcaagggtaactcaggggctcgtagccggcgaaaccgcccagcagatctgtgaagatctgagg

SEQ ID NO: 32913 - DNA, 225 bp, Artificial Sequence
  Description of Artificial Sequence: Synthetic coding sequence
atggggcgagactatcgaacttgcctgacaattgtgcagaagctaaagaagatggtggataaacctacgcagagaagcgtgtccaatgctgctactcgcgtctgcaggaccggaaggtcaagatggcgagatgtatgccggaacttcatgcggcggtaccagagtcgcgttacgcaaggcctggtagctggagaaacagctcaacagatctgtgaagatctgcgg

SEQ ID NO: 32914 - DNA, 225 bp, Artificial Sequence
  Description of Artificial Sequence: Synthetic coding sequence
atgggacgggattatcggacttgtctcacaatagtgcagaaactcaaaaaaatggtggataagcccactcagagatccgtgagtaacgctgctacaagggtttgcaggactggacgatctaggtggcgagacgtgtgtcgcaactttatgagaagatatcagtctcgggttacacagggactagtggctggggaaacagcccagcagatttgtgaagaccttagg

SEQ ID NO: 32915 - DNA, 225 bp, Artificial Sequence
  Description of Artificial Sequence: Synthetic coding sequence
atggggagagactaccgcacctgtctgactatcgttcagaaacttaagaagatggtggacaaacccacccagcgcagcgtctcaaacgccgcgacaagagtttgtcgtacgggccggtctcggtggcgcgatgtgtgtagaaacttcatgagaaggtaccagtcgcgcgtgactcagggcctagtggctggcgagaccgcccagcagatctgtgaggatctgaga

SEQ ID NO: 32916 - DNA, 225 bp, Artificial Sequence
  Description of Artificial Sequence: Synthetic coding sequence
atgggccgtgattaccgtacctgtttaaccatagttcagaagctgaaaaagatggttgacaagccaacccagcggtcagtatccaatgccgcaacgcgtgtgtgccgtacgggtcggagtcgctggcgggatgtatgtcgcaacttcatgcgacgctaccagtcccgcgtgacgcagggcctcgttgccggagagacagcccagcaaatatgtgaggaccttcgt

SEQ ID NO: 32917 - DNA, 225 bp, Artificial Sequence
  Description of Artificial Sequence: Synthetic coding sequence
atgggaagggactacagaacctgcttgactattgtgcagaagcttaagaagatggtggataaacccacgcagagaagcgtctctaatgctgccacccgcgtctgccggacaggtcgatcacgctggcgcgatgtatgtaggaattttatgaggaggtatcaatcccgcgtgacccagggcttggttgctggggaaaccgctcaacaaatctgtgaggatcttcga

SEQ ID NO: 32918 - DNA, 225 bp, Artificial Sequence
  Description of Artificial Sequence: Synthetic coding sequence
atgggacgcgactacagaacttgtctgaccatcgtgcagaagctcaaaaagatggtggacaagccaactcagcggagcgtttcgaacgcggccactcgtgtgtgtcggacgggccggtcacgctggagggacgtgtgccgcaacttcatgcggcggtaccagtcgcgggtcactcaggggctggtggccggagaaactgcgcagcaaatctgcgaggatctccgg

SEQ ID NO: 32919 - DNA, 225 bp, Artificial Sequence
  Description of Artificial Sequence: Synthetic coding sequence
atgggacgcgattaccgaacttgcctgactatcgtccaaaagctgaaaaagatggtcgacaagccaacgcaaaggtccgtgtccaacgcagcgaccagagtctgtcgcaccggacgtagccgctggagggacgtctgtagaaactttatgcggcgctaccagtcccgtgtgactcagggtcttgtggccggggaaaccgcacagcaaatctgcgaggatctgcgg

SEQ ID NO: 32920 - DNA, 225 bp, Artificial Sequence
  Description of Artificial Sequence: Synthetic coding sequence
atgggtcgtgattaccgtacttgtctaaccatagtccaaaagcttaagaaaatggtcgataagcccactcaacggagtgtgagcaacgctgccacacgcgtttgcaggaccggaagaagcaggtggcgggacgtatgtcgcaactttatgcgaaggtatcagagcagggttacacaagggctggtcgccggtgaaaccgcgcagcaaatatgcgaagatctcaga

SEQ ID NO: 32921 - DNA, 225 bp, Artificial Sequence
  Description of Artificial Sequence: Synthetic coding sequence
atggggcgcgactacagaacttgtttgacgatcgtgcaaaagctcaaaaagatggtcgataaaccgacccagagatcagtctccaatgccgcaaccagggtgtgccgaactggccgctcccggtggagagacgtgtgccgcaacttcatgcggcggtaccaatcgcgtgtgacccagggacttgtcgcaggagaaaccgctcagcagatttgcgaggatctgcgg

SEQ ID NO: 32922 - DNA, 225 bp, Artificial Sequence
  Description of Artificial Sequence: Synthetic coding sequence
atggggagagattacagaacgtgcctgacaattgttcagaagctgaaaaagatggtggacaaacccactcaacgcagcgtctcaaatgctgccacaagagtgtgtcggactgggcgatcaaggtggcgggatgtgtgtcgcaattttatgaggcgctaccagtctcgcgtgacccagggtctggtcgctggggaaacagctcaacagatctgcgaggatcttaga

SEQ ID NO: 32923 - DNA, 225 bp, Artificial Sequence
  Description of Artificial Sequence: Synthetic coding sequence
atgggccgagattaccggacgtgtctgactatcgttcagaaattgaaaaagatggtggataagcccactcagcggtccgtcagtaatgcagccacccgtgtgtgtcgcactggccggagtcgttggcgcgatgtgtgtagaaatttcatgcgtagatatcaatcacgcgtgactcaggggctggtggccggtgaaactgcccagcaaatctgcgaggatctgcga

SEQ ID NO: 32924 - DNA, 225 bp, Artificial Sequence
  Description of Artificial Sequence: Synthetic coding sequence
atgggtagggattacagaacatgcctcacaatagtgcaaaagctcaaaaagatggtggacaagcccacgcagaggtcggtttcaaatgccgctactcgtgtatgccgcactggcaggagtcggtggagagacgtttgtagaaacttcatgaggcgataccagtctcgagtgacccagggccttgttgccggcgaaactgcccagcaaatctgcgaggacttgagg

SEQ ID NO: 32925 - DNA, 225 bp, Artificial Sequence
  Description of Artificial Sequence: Synthetic coding sequence
atgggccgggactaccgtacttgcctgaccatcgtccagaagctgaaaaagatggtcgataagccgactcaaagaagcgtgtcaaacgcagcgacgagagtgtgtcgcaccggacggtcgcgctggcgcgatgtgtgccgaaatttcatgcggaggtaccagtcccgggttactcagggattggtggccggggaaaccgctcaacagatctgcgaggacctccgc

SEQ ID NO: 32926 - DNA, 225 bp, Artificial Sequence
  Description of Artificial Sequence: Synthetic coding sequence
atgggaagggactatcgtacctgtttgactattgttcaaaagctcaagaaaatggtggataagccaacccaacgttcagtgagcaacgcagcaactcgcgtgtgtcgcacgggtaggtccagatggcgagatgtctgcagaaatttcatgagacggtaccaatcaagagtgacccagggactggttgccggagaaaccgcccagcagatatgtgaggatcttcgc

SEQ ID NO: 32927 - DNA, 225 bp, Artificial Sequence
  Description of Artificial Sequence: Synthetic coding sequence
atgggaagggactaccggacgtgtctcacaatagtgcagaagcttaaaaagatggttgacaagccgacccagaggagcgtttcaaatgccgccacccgggtttgccggacggggcggagcaggtggcgggatgtgtgtagaaatttcatgaggagatatcaatccagagtgacacaggggcttgtggctggtgagaccgcccagcaaatatgcgaggacctgagg

SEQ ID NO: 32928 - DNA, 225 bp, Artificial Sequence
  Description of Artificial Sequence: Synthetic coding sequence
atgggtcgcgattaccggacctgtctgactattgtgcagaaactgaaaaagatggtggataagcctacccaaaggagcgtttccaatgcagcaactcgcgtgtgtaggacggggcggtccagatggagagacgtgtgtcggaactttatgaggagataccagtcccgggtcacgcagggcctcgtcgccggagagacggctcaacagatttgcgaggatttgaga

SEQ ID NO: 32929 - DNA, 225 bp, Artificial Sequence
  Description of Artificial Sequence: Synthetic coding sequence
atgggacgagattacaggacatgtctgacaatcgtacaaaaacttaaaaaaatggtggataaaccgacacaacgctctgtctctaatgcggctacacgtgtttgtagaacaggacgctcacgttggcgtgatgtttgtaggaactttatgcgtcgctaccaaagccgtgttacccagggcctcgtcgctggggagacggcccagcagatctgcgaagatctaagg

SEQ ID NO: 32930 - DNA, 225 bp, Artificial Sequence
  Description of Artificial Sequence: Synthetic coding sequence
atgggacgggattatcggacctgtctgaccattgtgcaaaagcttaagaaaatggtagacaagcctacgcaacggagcgtatccaatgccgcgaccagagtctgtcggacgggacgcagccgttggcgagatgtttgcagaaactttatgcgtagataccagagcagggtcacacaggggctggtagcaggcgagaccgcccagcagatctgcgaagacctgagg

SEQ ID NO: 32931 - DNA, 225 bp, Artificial Sequence
  Description of Artificial Sequence: Synthetic coding sequence
atgggccgggattataggacctgtctgaccattgtccagaagctgaaaaaaatggtagacaagcctacacaaaggtctgttagtaacgcagctactagagtctgcaggacaggtcgctcaagatggcgcgatgtgtgtagaaactttatgagacgatatcagagccgcgtgacacaaggcctggtcgccggagagaccgcccaacagatttgcgaagacctgcgc

SEQ ID NO: 32932 - DNA, 225 bp, Artificial Sequence
  Description of Artificial Sequence: Synthetic coding sequence
atgggaagggactaccgtacttgtctgacaatcgttcagaagctcaagaaaatggtggataaaccgacccaacggagtgtgagtaatgctgcaactcgcgtgtgccggacgggaaggtccaggtggcgggatgtgtgtcggaacttcatgaggcgctaccagtctcgcgttacccaagggctggtagctggtgaaactgctcagcagatatgtgaggatctccgc

SEQ ID NO: 32933 - DNA, 225 bp, Artificial Sequence
  Description of Artificial Sequence: Synthetic coding sequence
atggggcgggactaccgcacttgcctgacgattgtgcagaaacttaagaagatggtggacaagccaactcaaagatctgtttcgaacgctgccaccagagtgtgccgcaccggacgcagccgctggcgggatgtgtgcaggaatttcatgcggcgttaccaatcgcgggtcacccagggtctggtggccggcgaaaccgcgcagcagatctgtgaggatctgcgg

SEQ ID NO: 32934 - DNA, 225 bp, Artificial Sequence
  Description of Artificial Sequence: Synthetic coding sequence
atgggtcgggattaccgcacttgtcttaccattgtgcagaagttgaaaaagatggtggataagcctacccagcgaagcgtctcgaatgccgctactagagtctgtaggactgggaggtcacgctggcgggatgtgtgtcggaactttatgaggaggtaccagagcagggtgactcaagggcttgtggcaggagaaaccgcgcaacagatctgcgaggatcttcgc

SEQ ID NO: 32935 - DNA, 225 bp, Artificial Sequence
  Description of Artificial Sequence: Synthetic coding sequence
atggggagagattatcgcacatgtttaactattgtccaaaaactaaaaaaaatggttgacaaacctacacagagatctgttagtaatgctgccacgcgcgtgtgcaggacaggacggtcacgatggcgggatgtatgtagaaattttatgcggcgatatcagtcccgcgtaactcaggggctggtggcaggagagacggcacagcagatctgtgaagatctcaga

SEQ ID NO: 32936 - DNA, 225 bp, Artificial Sequence
  Description of Artificial Sequence: Synthetic coding sequence
atgggccgtgactacagaacctgcctcactatcgtccaaaaacttaagaagatggtggacaagcccacgcagcgttctgtctctaacgcagcaacccgggtgtgtcgtaccggacgctcccgctggagagatgtgtgtaggaacttcatgcggcggtaccaatcgagggtcactcagggccttgtggcaggggagactgctcaacagatttgtgaagatctgcgc

SEQ ID NO: 32937 - DNA, 225 bp, Artificial Sequence
  Description of Artificial Sequence: Synthetic coding sequence
atgggtagagattaccgcacttgtcttactatcgtccaaaagctgaaaaagatggtggataagccaactcagcgctctgtaagcaacgcagcaactcgcgtgtgtagaaccggccgttcgagatggcgggatgtgtgccgaaactttatgaggagataccagtcacgggtgacgcagggtcttgtggcaggagaaactgcccaacagatttgtgaggacctgcgg

SEQ ID NO: 32938 - DNA, 225 bp, Artificial Sequence
  Description of Artificial Sequence: Synthetic coding sequence
atggggagagactaccggacctgcctcaccatcgtgcaaaaactgaagaaaatggtggacaagccgactcagcggtcggtgtccaatgccgctacccgagtatgccggactggccgatcacggtggagagatgtctgcaggaacttcatgcggcgctaccagtcccgcgtgactcagggactggtggctggagaaacggcacaacagatttgtgaggatttgcgc

SEQ ID NO: 32939 - DNA, 225 bp, Artificial Sequence
  Description of Artificial Sequence: Synthetic coding sequence
atgggtagagattacagaacctgtctgaccatcgtgcaaaaacttaagaagatggtggacaagccgactcagagatcggtttccaacgctgccaccagagtctgtcggactggacgaagccggtggcgggatgtgtgccgcaactttatgaggcgctaccaatccagggtgactcagggactggtagccggggaaacggcgcagcagatctgtgaggacttgagg

SEQ ID NO: 32940 - DNA, 225 bp, Artificial Sequence
  Description of Artificial Sequence: Synthetic coding sequence
atgggtagagattataggacctgtttgacgatcgtccagaagcttaagaagatggtggataagcctactcagcggagtgtatctaacgccgccacacgcgtttgtaggaccggaaggagccgatggcgggacgtttgtcggaatttcatgaggcggtaccagagcagagtgacccagggtttggtggccggggagacagctcagcagatctgtgaagatctcaga

SEQ ID NO: 32941 - DNA, 225 bp, Artificial Sequence
  Description of Artificial Sequence: Synthetic coding sequence
atgggaagagattatagaacttgtcttactatcgtacaaaaactaaaaaaaatggttgataaacctactcagaggagtgtatctaacgcagcaaccagggtatgtaggacggggcgttctcgatggagggacgtttgtaggaattttatgagacgatatcaatcgcgagttacacagggccttgtggctggagaaaccgcacagcaaatctgtgaggatctcagg

SEQ ID NO: 32942 - DNA, 225 bp, Artificial Sequence
  Description of Artificial Sequence: Synthetic coding sequence
atgggaagggattaccgcacttgtttaacaattgttcaaaagttaaaaaagatggtcgacaaacccacgcagcgttctgttagcaacgcagcaactagagtttgtcgaactggaagatccagatggcgagacgtctgtcgtaatttcatgcgacgatatcagagccgagttacacaaggactagtagctggcgaaacggcacaacaaatatgcgaagacttaaga

SEQ ID NO: 32943 - DNA, 225 bp, Artificial Sequence
  Description of Artificial Sequence: Synthetic coding sequence
atgggacgcgattaccgcacatgcctgaccatagtacaaaaactgaaaaagatggtcgacaagccaactcaaagatccgtctccaatgccgcaacaagagtctgtaggactggccgcagtcgctggcgcgatgtgtgtaggaacttcatgaggcggtatcagagtcgggttacccagggcttggtagccggggagacagcccagcagatttgcgaggacctgaga

SEQ ID NO: 32944 - DNA, 225 bp, Artificial Sequence
  Description of Artificial Sequence: Synthetic coding sequence
atgggccgggattacagaacatgtcttaccattgtacagaaattgaagaagatggtcgataagcccacccagagatctgtcagcaacgccgctacccgcgtatgcagaaccggaagaagtcggtggcgcgatgtgtgccgtaacttcatgagacggtatcagtcccgcgtcacacagggccttgttgccggggagacagcccagcagatttgtgaggatctaaga

SEQ ID NO: 32945 - DNA, 225 bp, Artificial Sequence
  Description of Artificial Sequence: Synthetic coding sequence
atggggcgggactaccgtacatgtctcaccattgttcagaaattgaaaaagatggttgataaacccacgcagcgcagtgtgtcaaatgctgcgacacgcgtctgccggacaggtaggagccggtggcgggacgtgtgtcgcaattttatgaggagatatcagtcccgcgtgacccaaggcctagttgcgggcgagacagcgcaacagatatgcgaggacctccgg

SEQ ID NO: 32946 - DNA, 225 bp, Artificial Sequence
  Description of Artificial Sequence: Synthetic coding sequence
atggggagagactaccgcacgtgcctgaccatcgtgcagaaactgaagaaaatggtcgacaaaccaacccagcggtcggtgtcaaacgcagcgacccgggtgtgccgcaccggacgcagcagatggagagacgtgtgccggaatttcatgaggagataccagtcgcgcgtcacgcaaggactggtggccggcgaaactgctcagcagatctgtgaggatttgcga

SEQ ID NO: 32947 - DNA, 225 bp, Artificial Sequence
  Description of Artificial Sequence: Synthetic coding sequence
atgggaagagactatcgcacctgtctaacaatcgtgcagaagcttaaaaaaatggtggacaagcctacacaaaggtctgtctccaacgccgccacacgtgtgtgcagaacaggccgttcgcgttggagagatgtttgcagaaattttatgcgtcgctaccagtctcgagtgacccagggtctagttgccggagaaacagcccagcaaatctgtgaagatttgagg

SEQ ID NO: 32948 - DNA, 225 bp, Artificial Sequence
  Description of Artificial Sequence: Synthetic coding sequence
atggggagagattacaggacgtgccttacgattgttcagaagctaaaaaagatggtggacaagcccactcagaggtctgtgtctaacgcggcgactagggtctgtcgcaccggcagaagcagatggcgggacgtctgcaggaatttcatgcggcggtatcagtcccgtgttacccaggggctggtggcaggggagacagcccagcagatctgcgaggaccttaga

SEQ ID NO: 32949 - DNA, 225 bp, Artificial Sequence
  Description of Artificial Sequence: Synthetic coding sequence
atgggccgcgactaccggacatgcctcaccatcgtccaaaagctgaagaagatggtggataaacccacgcagagatcagtgtcaaatgccgccactcgggtctgtcgaacaggtcggtcacgctggcgagacgtgtgcagaaattttatgcggagataccagtcacgggtgacacagggtctggtcgccggggagaccgcccagcagatttgtgaggatttgaga

SEQ ID NO: 32950 - DNA, 225 bp, Artificial Sequence
  Description of Artificial Sequence: Synthetic coding sequence
atgggccgggattacaggacatgtttgactattgtgcaaaaattgaaaaaaatggtggataaaccgacacagagaagtgtgtccaacgctgcgaccagagtttgccggacgggaaggtcccgatggagagacgtttgtcgaaatttcatgcgccggtaccagtctcgcgtgactcagggacttgtcgcaggggagacagctcagcagatctgtgaggacttgaga

SEQ ID NO: 32951 - DNA, 225 bp, Artificial Sequence
  Description of Artificial Sequence: Synthetic coding sequence
atgggcagggactatcggacttgcttgactatcgtccagaagttgaaaaagatggtcgacaagcccactcagcgttccgtctccaacgccgcgacaagagtttgtcgcacaggtcggtcccgatggcgtgacgtgtgccgtaattttatgcgtcgctatcaatcgcgcgtcacccagggactggttgctggcgagaccgcacagcaaatctgcgaggacctgcgt

SEQ ID NO: 32952 - DNA, 225 bp, Artificial Sequence
  Description of Artificial Sequence: Synthetic coding sequence
atgggaagagattaccggacttgtcttactattgtccaaaaactgaagaagatggtcgataagccaacccaacggtctgtgtcaaatgccgccacccgggtgtgtcggaccggaaggtccagatggcgcgacgtttgtcgtaacttcatgagacgctaccagtccagagtgacccagggcctggtggcaggagaaactgcccagcagatctgtgaagatctcaga

SEQ ID NO: 32953 - DNA, 225 bp, Artificial Sequence
  Description of Artificial Sequence: Synthetic coding sequence
atgggccgggactaccgtacctgtctgacgatcgtgcagaagctcaagaaaatggtggacaagccaacccagcggagcgtcagcaatgccgccacccgggtgtgtagaaccggacgcagccggtggagagacgtgtgccgaaacttcatgagacggtaccagtcgagggtgacccagggactcgtcgctggcgaaaccgcacaacaaatttgcgaggacctgcgg

SEQ ID NO: 32954 - DNA, 225 bp, Artificial Sequence
  Description of Artificial Sequence: Synthetic coding sequence
atgggaagagactaccgaacgtgtcttactatagtgcaaaagctgaagaaaatggtggataagcctacccaacgttcagtgtccaatgctgcaaccagagtgtgtcgcactggtaggagccgatggcgggatgtctgcagaaacttcatgcgtcgatatcagtcacgagttactcaagggttggtcgcgggcgaaaccgcacaacagatctgtgaagatctgcga

SEQ ID NO: 32955 - DNA, 225 bp, Artificial Sequence
  Description of Artificial Sequence: Synthetic coding sequence
atgggacgcgattacagaacttgcctgaccatcgtgcagaagctcaaaaagatggttgacaagccgacccagcggagtgtctctaacgccgcgaccagggtgtgccgcaccggtcggagccgctggcgcgacgtgtgcagaaatttcatgcgtcggtaccaatcgagagtgactcagggcttggtcgctggggaaactgcccagcaaatctgtgaggacctccgc

SEQ ID NO: 32956 - DNA, 225 bp, Artificial Sequence
  Description of Artificial Sequence: Synthetic coding sequence
atgggcagagattaccgaacctgtctcaccattgtgcagaagctcaagaagatggtcgacaaacccacgcaacggtcagtctcgaacgccgctactagggtttgtcggacggggaggagcagatggcgtgacgtgtgccgcaactttatgagacggtaccaaagccgagtgacccagggacttgtggcaggtgaaaccgcacaacagatctgtgaagatctgcgt

SEQ ID NO: 32957 - DNA, 225 bp, Artificial Sequence
  Description of Artificial Sequence: Synthetic coding sequence
atgggacgggattatcggacctgcctgacgatcgtgcaaaagctgaagaaaatggtcgacaagcccacacaaaggtcagtgtccaacgcagctacgagggtgtgtcgaacagggcgcagtcgttggcgtgatgtttgtcgtaatttcatgcgaaggtaccaatccagagtgacccagggactggtagccggtgaaaccgcccaacagatttgcgaggacctcaga

SEQ ID NO: 32958 - DNA, 225 bp, Artificial Sequence
  Description of Artificial Sequence: Synthetic coding sequence
atgggaagggattaccggacttgtctcactatcgtccagaagctgaagaaaatggttgacaagccaacccaacggtcggtgtccaatgcagctacgcgcgtctgtaggaccggtcgttcacggtggcgtgacgtgtgccgcaactttatgagaagataccaatcgcgcgtcactcaaggcctggtggcaggcgaaacggcccagcagatatgcgaggatctccgg

SEQ ID NO: 32959 - DNA, 225 bp, Artificial Sequence
  Description of Artificial Sequence: Synthetic coding sequence
atgggccgggactaccgcacttgcctgactattgtccaaaagctgaagaaaatggtggataagccgactcagcgtagcgtctcaaatgccgcgacccgggtgtgcaggaccggacggtccagatggagagatgtgtgccgtaatttcatgcggcgctaccaatcgcgggtgactcagggactggtggctggggaaactgcgcagcagatctgcgaagatctgagg

SEQ ID NO: 32960 - DNA, 225 bp, Artificial Sequence
  Description of Artificial Sequence: Synthetic coding sequence
atgggccgagactacagaacgtgcttgacgattgttcagaaactcaagaagatggtggacaagcctacgcaaaggtccgtgagcaatgcagccaccagagtttgcagaactgggagatctagatggcgggacgtgtgccggaatttcatgagaagataccagtcaagggtgactcagggtctggttgcaggggagaccgcacagcagatttgtgaagacctccgc

SEQ ID NO: 32961 - DNA, 225 bp, Artificial Sequence
  Description of Artificial Sequence: Synthetic coding sequence
atgggtagagattatagaacttgtttaacaatagttcaaaaattaaaaaaaatggtagataagccaactcaacgatcagtatctaacgctgctacaagggtatgtagaacaggaagatctagatggagagatgtttgtcgaaatttcatgagacgttatcaatcccgagttacacaaggtcttgttgctggagaaacagcacaacaaatttgtgaagacttaaga

SEQ ID NO: 32962 - DNA, 225 bp, Artificial Sequence
  Description of Artificial Sequence: Synthetic coding sequence
atggggagagactaccgcacttgcctgacaatcgttcagaaactcaaaaagatggtcgataagcctacgcaacgttcggtgtctaacgcagccacgagagtttgccgaactggacgaagtcgttggcgcgatgtttgtcgcaatttcatgcggagatatcagtccagagtcactcagggcctcgtcgctggggaaacagcccagcagatttgcgaagatctccgt

SEQ ID NO: 32963 - DNA, 288 bp, Artificial Sequence
  Description of Artificial Sequence: Synthetic coding sequence
atggccacttgggccctgctcctgctcgcagcaatgcttctgggaaaccctgggctggtgttcagcggcagggactaccgtacctgtctgactatcgtccaaaagctgaaaaagatggtcgataagcctacccaacgctccgtgtccaatgccgcaacgcgggtgtgcagaaccggaaggtcccgatggcgagacgtgtgtagaaactttatgcgtagataccaatcgcgcgtcactcagggtcttgtggcgggagaaaccgcccagcaaatatgcgaggatcttaga

SEQ ID NO: 32964 - DNA, 288 bp, Artificial Sequence
  Description of Artificial Sequence: Synthetic coding sequence
atggccacgtgggcgctgctgctgcttgccgccatgttgctcgggaaccctggtctggttttcagtggacgcgactacagaacttgtctgactatcgtacagaaactcaagaagatggtggacaagccgacccagagatccgtttcaaatgcagcgacccgggtgtgccgtaccggccgatcgcggtggcgcgatgtctgccggaactttatgcgccgctaccagagccgcgtgacccagggactggtggccggagagactgctcaacagatctgcgaagatttgaga

SEQ ID NO: 32965 - DNA, 288 bp, Artificial Sequence
  Description of Artificial Sequence: Synthetic coding sequence
atggctacgtgggccctgctgctcttggcagcaatgcttctgggcaatccgggactcgtgtttagcggtcgcgactaccgcacttgcctcaccatcgtccagaagctcaagaaaatggtggataagcccacccagagatcggtttccaatgcagccactagggtgtgccgcactggccgctcaagatggcgggacgtctgcagaaatttcatgaggaggtaccaaagcagggttacgcagggactcgtggctggggaaactgctcagcagatctgcgaggacctgcgg

SEQ ID NO: 32966 - DNA, 288 bp, Artificial Sequence
  Description of Artificial Sequence: Synthetic coding sequence
atggccacttgggcacttctgctgctcgcagctatgctcctcgggaatccgggcctcgtgttcagtgggcgggattaccgcacttgcctgactatcgtgcagaagttgaagaaaatggtggacaagccgactcagcggtcggtgtccaacgccgccactcgcgtgtgccggaccggacgcagccgctggagggatgtgtgccggaactttatgcggcggtaccaatcgagggtgacccagggcctggtcgccggagaaaccgcacaacagatctgcgaggacctgcgc

SEQ ID NO: 32967 - DNA, 288 bp, Artificial Sequence
  Description of Artificial Sequence: Synthetic coding sequence
atggccacctgggccttattgctgctcgctgcaatgctgctgggtaacccgggccttgtttttagcggaagggattatcggacatgcctcaccatcgtacaaaaactcaaaaagatggtcgataaacccacccagcgctcggtgtccaacgctgccacccgggtctgtcgcactggacggtccagatggagggacgtgtgccgtaattttatgcgcaggtaccagtctcgcgtgacccagggcttggtagccggcgagacagcacagcagatctgcgaggacttgcga

SEQ ID NO: 32968 - DNA, 288 bp, Artificial Sequence
  Description of Artificial Sequence: Synthetic coding sequence
atggctacctgggcccttcttttgctggctgccatgctcctaggcaaccctggcctcgttttttcgggaagagactaccgcacctgtctcacaattgttcagaagctgaaaaagatggtggataaacccactcagaggtccgtgagcaatgctgctacgagggtctgcagaaccgggcgcagcaggtggagggacgtttgtcggaactttatgcgcagataccagtccagggtaacccagggactcgttgcaggggagacagcgcagcagatctgtgaagatttgcgc

SEQ ID NO: 32969 - DNA, 288 bp, Artificial Sequence
  Description of Artificial Sequence: Synthetic coding sequence
atggcaacctgggcgctgctgctgctggcggccatgctgctgggcaacccggggctggtgttctcgggccgtgactaccggacctgccttactatcgtgcagaaactcaagaaaatggtggataagcctacccaacgcagcgtctcaaacgccgcaacgcgggtgtgcagaaccgggcgctcaagatggagggatgtgtgcaggaactttatgcgccgctaccagtcgcgggtgacccaagggctcgtggcgggagaaaccgcacagcaaatctgcgaggatctgaga

SEQ ID NO: 32970 - DNA, 288 bp, Artificial Sequence
  Description of Artificial Sequence: Synthetic coding sequence
atggcgacctgggcacttttgctcctggcagcaatgctgctgggaaaccccggattggtattcagcggtagagactaccggacttgcctcaccatcgtgcaaaaactcaaaaagatggttgataagccgactcagcgttcggtgtccaacgccgccacgagagtgtgcagaactggccgcagcaggtggagagacgtgtgtcggaatttcatgcggcggtaccagtctagggtgacccaagggctcgtggcaggggaaactgcgcaacagatttgcgaggacctgaga

SEQ ID NO: 32971 - DNA, 288 bp, Artificial Sequence
  Description of Artificial Sequence: Synthetic coding sequence
atggctacgtgggcactgttgcttctggcagctatgcttcttggtaatcctggcttagtgttttccggcagggattaccggacgtgtctgacgatagttcagaaattaaaaaagatggtagacaaaccgacgcagcgatctgtgtccaatgcggcaacgcgcgtatgccgcacaggaagaagtcgctggcgtgacgtgtgccgaaacttcatgagacggtaccagtctagagtaactcaaggactggtcgcgggagaaacggcccaacagatttgcgaggatttacgc

SEQ ID NO: 32972 - DNA, 288 bp, Artificial Sequence
  Description of Artificial Sequence: Synthetic coding sequence
atggcaacgtgggccctgttgctgttggcagccatgctgttgggtaacccaggactcgtattttccgggagggactaccggacgtgcctgacgatcgttcagaagctcaagaagatggtggacaagcctacccagcgcagtgtcagtaatgcagcaacccgggtttgccgcaccggccgctctcgatggagagatgtgtgcaggaatttcatgaggcgctatcagtcccgcgtgacccagggtttggtggcaggcgagactgcccagcagatatgcgaggacttacgg

SEQ ID NO: 32973 - DNA, 288 bp, Artificial Sequence
  Description of Artificial Sequence: Synthetic coding sequence
atggctacctgggctctgttactactcgctgccatgttattggggaaccctggcctcgtgttttccgggcgtgactacaggacatgtctgaccatcgttcagaaactcaagaagatggtggataagcccacccaacggagcgtatctaatgccgctactcgggtctgcagaacaggccgctctcggtggagagatgtgtgtcggaactttatgagacgctaccagtcaagagttacgcagggactcgtcgcgggggaaacagcccagcagatttgcgaggatcttcgg

SEQ ID NO: 32974 - DNA, 288 bp, Artificial Sequence
  Description of Artificial Sequence: Synthetic coding sequence
atggcgacgtgggcactcttgctgcttgccgcaatgttgctgggtaacccaggacttgtgttttcgggaagagactaccgaacttgtctcaccattgtccagaaactcaagaagatggtggacaagcctactcaacgttccgtttcgaacgcagccacccgtgtgtgccgaactggcaggtctaggtggcgcgatgtgtgtcggaatttcatgagaaggtatcagtcccgagtcacccagggccttgtggcaggagagactgcgcaacaaatctgtgaagatctccgg

SEQ ID NO: 32975 - DNA, 288 bp, Artificial Sequence
  Description of Artificial Sequence: Synthetic coding sequence
atggcgacttgggcgttgctcctgcttgccgcgatgctgcttggcaaccccggactcgtgttcagcggtcgggattaccgtacttgcctcaccatcgtgcaaaagttgaaaaagatggtggacaagccaactcagcggtcagtctccaatgccgcaactcgagtgtgcaggaccggcaggtcgagatggcgcgacgtctgccggaactttatgcgccggtaccagtcgagagtgacccagggactggtggcgggggaaactgcccaacagatctgtgaggatctccgg

SEQ ID NO: 32976 - DNA, 288 bp, Artificial Sequence
  Description of Artificial Sequence: Synthetic coding sequence
atggccacctgggcattgctgcttctcgccgccatgctactcggtaaccccgggctcgtgttctcaggtagggactacagaacttgtctgactattgtgcagaagctcaaaaaaatggtcgataagccaacgcagcgatcagtgtcgaacgctgcaactcgagtttgtaggaccgggaggagcagatggcgggacgtttgtagaaacttcatgaggcgttaccagagccgtgttacacaagggctggtggctggggagacagcacagcagatatgtgaagacctgagg

SEQ ID NO: 32977 - DNA, 288 bp, Artificial Sequence
  Description of Artificial Sequence: Synthetic coding sequence
atggcgacttgggcattgctcctgttggctgctatgctgctagggaaccctggactcgttttctccggaagggattataggacctgtttaactattgtccaaaaactcaagaaaatggtggacaaaccgacacaacggtctgtttccaatgccgcgacccgcgtttgtagaactggacgttctcggtggcgtgacgtgtgtagaaattttatgagacgataccaatctagagttacgcaaggattggtggctggagaaaccgcgcaacaaatctgtgaagatctacgt

SEQ ID NO: 32978 - DNA, 288 bp, Artificial Sequence
  Description of Artificial Sequence: Synthetic coding sequence
atggcgacgtgggcacttttattgctggcggccatgctgttggggaacccgggtttggtgttcagcggccgcgactataggacctgcttaaccatagtccagaagctcaagaaaatggttgacaaaccaacgcaacgatctgtcagcaacgccgccacccgcgtgtgcaggactggcagatcgcgctggcgcgacgtctgtcgaaactttatgcgccgttaccagagccgggtgactcagggccttgtagccggagagactgcgcagcagatatgcgaagatctgaga

SEQ ID NO: 32979 - DNA, 288 bp, Artificial Sequence
  Description of Artificial Sequence: Synthetic coding sequence
atggcaacctgggccctcctgctgctcgctgcaatgcttctgggtaatccaggtttggtcttttcgggtcgggattaccgaacttgtctgactattgtccaaaagctgaagaaaatggtggacaaaccaacccagagatccgtcagcaacgcagccacccgggtgtgtagaactggaagatccaggtggcgcgatgtgtgtagaaactttatgcgacgctaccagtccagagtcacccaaggccttgtggcaggagaaactgcacagcagatctgcgaggaccttcgc

SEQ ID NO: 32980 - DNA, 288 bp, Artificial Sequence
  Description of Artificial Sequence: Synthetic coding sequence
atggccacttgggcactgctactgctggcagccatgctgcttggtaatcctggattggttttttcaggaagagactaccgcacatgcctcactatcgtacagaaactgaagaagatggtggacaagccgactcaaaggtcagtttcaaacgctgctacgcgcgtttgtcgcacaggacggagtcggtggcgcgacgtgtgtcgaaatttcatgcggcgctaccaaagccgagtgacccagggcctcgtggctggtgaaactgcgcagcagatctgtgaggaccttcgg

SEQ ID NO: 32981 - DNA, 288 bp, Artificial Sequence
  Description of Artificial Sequence: Synthetic coding sequence
atggccacatgggcactactgttgctggcggcaatgctccttggcaatccaggattggtgttctctggacgggactaccgcacatgtctgactatcgtgcagaaattgaaaaaaatggtcgataagcctactcagcgatcagttagcaatgcagcgaccagagtttgtaggactggtcgcagtcgctggagggatgtctgtcggaacttcatgcgccggtaccagagccgagtgactcaggggctggtcgcgggggaaactgctcaacaaatttgtgaggatttgcgt

SEQ ID NO: 32982 - DNA, 288 bp, Artificial Sequence
  Description of Artificial Sequence: Synthetic coding sequence
atggctacctgggcactgctcctgctcgcagcaatgctgcttggaaaccccggcttggtgttcagcggacgggactacagaacttgtctgactattgtgcagaagctgaagaagatggtggataagccaacccaaaggtcggtgtcgaacgccgcaacccgtgtgtgtcgcacgggccgttcccgttggcgcgatgtgtgccgcaactttatgaggagataccagtcacgggtcactcaaggtttggtggccggagaaactgcccagcaaatttgtgaggatctgaga

SEQ ID NO: 32983 - DNA, 288 bp, Artificial Sequence
  Description of Artificial Sequence: Synthetic coding sequence
atggccacatgggcactcctcctcctggccgctatgctgctcggtaatccaggactcgttttttctggcagagactacaggacatgtctcaccattgtacaaaagctgaagaagatggtggataaaccgacccagaggtcggttagtaatgcagcgaccagggtgtgccgcaccggtcgaagtagatggcgcgatgtatgccgtaatttcatgaggagataccagtctcgcgtgacacagggcctggtggccggcgagaccgcccagcagatatgcgaagacttgcga

SEQ ID NO: 32984 - DNA, 288 bp, Artificial Sequence
  Description of Artificial Sequence: Synthetic coding sequence
atggcaacttgggctctactgctgctcgccgctatgttgttaggcaatccaggcttggttttctccggaagagattataggacttgtctgactattgtccagaaattgaagaaaatggtggataaaccaacccagcgttccgtgtcaaacgccgctacccgtgtctgcagaactgggcgatcaaggtggcgagacgtgtgtaggaatttcatgagaaggtaccaaagtagagtgacccaagggcttgtggccggagagaccgcccaacagatttgcgaagatttgcgc

SEQ ID NO: 32985 - DNA, 288 bp, Artificial Sequence
  Description of Artificial Sequence: Synthetic coding sequence
atggctacatgggcactcctgttacttgcagccatgctgcttggcaatcctgggctggtcttcagtggaagggactacagaacatgcttgaccatagtgcaaaagctgaagaagatggtcgataaacccacccagcggtccgtctccaatgcagctacacgtgtgtgtcgaacggggagatcccgatggagagacgtctgtcgtaattttatgcgcaggtatcagtcaagagtgacgcagggactagtcgcgggagaaaccgcacagcagatctgcgaagacttgagg

SEQ ID NO: 32986 - DNA, 288 bp, Artificial Sequence
  Description of Artificial Sequence: Synthetic coding sequence
atggccacctgggccctgctcctgcttgccgctatgctcttgggtaaccccgggctggtctttagcggccgtgactaccggacctgccttactatcgttcagaagctgaagaagatggtcgataaaccgacgcaaagatccgtgtcgaacgcagctactcgagtgtgcagaacgggacggtcccgctggagggacgtgtgtcgcaatttcatgaggcgataccagtctcgggtgacccagggattggtcgcgggggaaactgctcaacagatctgcgaggatctgcgc

SEQ ID NO: 32987 - DNA, 288 bp, Artificial Sequence
  Description of Artificial Sequence: Synthetic coding sequence
atggctacatgggcactgctcctgctggctgctatgcttcttggtaatccaggcctggtgtttagcggacgagattacagaacctgtctgactatcgtccaaaagctgaaaaagatggtcgacaagccaactcagagaagcgtgtccaacgcagccacccgtgtgtgcaggaccgggaggtctcggtggagggatgtgtgcagaaatttcatgcgcaggtatcaaagcagggtgacacaaggcctggtagcgggcgagaccgcgcagcagatctgtgaggatctgaga

SEQ ID NO: 32988 - DNA, 288 bp, Artificial Sequence
  Description of Artificial Sequence: Synthetic coding sequence
atggctacttgggccctgctactcctggccgctatgctgctgggaaaccccggtttggttttctcggggcgggactataggacctgtttgaccatcgtgcaaaaattaaagaaaatggttgataagcccacccagaggagtgtcagcaacgccgccacccgggtttgtcggactgggagatcaagatggagggacgtgtgccgcaatttcatgcgtcgctatcaaagccgggtaacccaggggctggtggccggggagacagcccagcaaatttgtgaagacctgaga

SEQ ID NO: 32989 - DNA, 288 bp, Artificial Sequence
  Description of Artificial Sequence: Synthetic coding sequence
atggccacatgggcgttactgttacttgcggctatgcttttaggaaatcccggtttggtgttctcgggccgggattacagaacctgtctgaccatcgtgcagaaactgaaaaagatggtggataaaccaacccagcgtagcgtctcaaatgctgctacccgggtctgcaggacgggcagatcgcggtggagggatgtgtgccgaaattttatgcgtcggtatcagtcaagagtaacccaggggctcgtcgcgggcgaaaccgcacaacagatctgcgaggacttgaga

SEQ ID NO: 32990 - DNA, 288 bp, Artificial Sequence
  Description of Artificial Sequence: Synthetic coding sequence
atggccacttgggccttgctactcctggcagccatgctgcttggaaacccaggtctggttttcagcggacgggactatagaacctgcctaacaatagtgcagaagttgaaaaagatggttgacaagcccacccaacggagcgtaagcaacgcagcaactcgtgtgtgtaggacgggaagatcacggtggcgcgacgtgtgcagaaactttatgcgacggtaccagagccgggtcactcaggggttggtcgccggagagactgcacagcagatttgcgaagatctcagg

SEQ ID NO: 32991 - DNA, 288 bp, Artificial Sequence
  Description of Artificial Sequence: Synthetic coding sequence
atggcaacctgggccctcctcttgctggctgccatgttgctgggtaaccctggactggttttctctggcagggattacaggacctgcctcaccattgtgcagaagctgaaaaaaatggtcgacaagccgacccagcgatccgtgtccaatgcagcgactagggtgtgccgtaccggcagatctcgatggcgagacgtgtgcaggaactttatgcgtaggtatcagtcacgggtgactcagggcctcgtggcaggagagacggcacagcaaatctgtgaggacttgcga

SEQ ID NO: 32992 - DNA, 288 bp, Artificial Sequence
  Description of Artificial Sequence: Synthetic coding sequence
atggcgacctgggccctgctgctgctggcagcgatgctgttgggaaatcctggtctggtgttttcggggcgcgattaccggacgtgtctgaccatcgtccagaaattgaaaaagatggtggataagccaacccagagatccgtttcaaacgccgctacccgggtgtgtcgtacgggaaggtcgcggtggcgggacgtgtgcagaaatttcatgcgccgctaccaatcccgggtgactcagggccttgtggccggggaaacggcgcagcaaatctgcgaggatcttaga

SEQ ID NO: 32993 - DNA, 288 bp, Artificial Sequence
  Description of Artificial Sequence: Synthetic coding sequence
atggccacatgggcgttgttgctccttgcggccatgctgttagggaatccgggtctggtcttctcagggcgcgattaccgtacttgcctgactatcgtacaaaaactaaagaagatggttgataagcctacacaacgttctgtctccaatgcggccactcgagtttgtagaacgggccgttccagatggagagacgtctgccgcaacttcatgcgtcgttaccagtctagggttacgcaaggattggttgccggggaaactgcgcaacaaatttgtgaagaccttcgt

SEQ ID NO: 32994 - DNA, 288 bp, Artificial Sequence
  Description of Artificial Sequence: Synthetic coding sequence
atggcaacttgggctctgctcttgctggcagccatgctcctgggtaaccccggactcgtattttctggtcgtgattaccgcacctgccttaccattgtgcagaagcttaaaaagatggtggataaacccacacagaggtcagtctctaatgccgctacccgcgtttgcagaacaggtagatctaggtggcgtgacgtctgccgcaactttatgaggagataccagtcccgcgtcactcagggtctggtggcaggagagacagctcagcaaatctgcgaagatctgcgt

SEQ ID NO: 32995 - DNA, 288 bp, Artificial Sequence
  Description of Artificial Sequence: Synthetic coding sequence
atggcaacttgggctcttcttttgctcgcagcgatgctgctgggtaatcctgggctggtgttctctggtagagattacagaacctgtctgaccatcgtccaaaaactcaagaaaatggtcgacaagccgacccaacgatcggtcagcaatgcagccacgagggtgtgtagaactgggagatccagatggcgtgatgtctgccgaaactttatgcggcgataccagtcacgtgtgacccagggtttggtggcaggagaaaccgcccaacagatttgtgaagatctgcga

SEQ ID NO: 32996 - DNA, 288 bp, Artificial Sequence
  Description of Artificial Sequence: Synthetic coding sequence
atggcaacttgggcactgctcttgctggccgccatgttgctcggaaaccctggcctcgtgttttctggccgggattaccggacctgtcttacaattgtacaaaagctgaagaagatggtggacaagccaacgcagagatctgtgtccaacgccgctacgcgggtttgcagaacggggcgcagccgatggcgcgatgtttgccgaaatttcatgagacgctaccagagcagagtgacacagggtctggtggctggagaaacggcccagcaaatatgtgaggacctgaga

SEQ ID NO: 32997 - DNA, 288 bp, Artificial Sequence
  Description of Artificial Sequence: Synthetic coding sequence
atggccacctgggccctgctcctgctggccgccatgctccttgggaatccgggccttgtgttctcgggacgcgactaccgcacctgcctcactatcgtgcagaagttgaagaagatggtggacaagcctacccagagatcggtgagcaacgccgccaccagagtgtgccggaccggcagatcgcgctggagagacgtgtgccgcaacttcatgcgacgctaccaatccagggtgacgcaaggactcgtggcgggcgaaacggctcaacagatctgcgaagatctgcgc

SEQ ID NO: 32998 - DNA, 288 bp, Artificial Sequence
  Description of Artificial Sequence: Synthetic coding sequence
atggcgacttgggccttgctgctgctggcagcaatgctgctcggtaatcctggtcttgtcttttcgggacgggattacagaacttgcttgaccatcgtgcagaaactgaaaaagatggtcgataagcctacccaacgttcggtgtctaatgcagcaactcgggtttgccgcacgggccgctcaaggtggagagacgtgtgtaggaacttcatgaggcgctaccaatcgagagtgacccaaggactcgtggcaggagaaactgcacaacagatttgtgaagatctccgg

SEQ ID NO: 32999 - DNA, 288 bp, Artificial Sequence
  Description of Artificial Sequence: Synthetic coding sequence
atggcaacctgggcccttttactcttggccgcaatgttactgggaaatcctggcttagtattctcggggagggactaccgcacatgtctcactatcgtgcaaaaactaaagaagatggtggacaagccaacgcagcgatccgtgtcaaacgccgccacacgtgtgtgccgcactggtcgctcgcgctggagggacgtttgccggaactttatgaggcggtaccagagccgggttacacagggtctggtggcgggcgagaccgctcagcagatctgcgaggacctccga

SEQ ID NO: 33000 - DNA, 288 bp, Artificial Sequence
  Description of Artificial Sequence: Synthetic coding sequence
atggccacttgggctctgctgctcctggcggctatgctgctgggcaaccctggactcgtgttcagcggccgggattaccgcacctgcctgaccatcgtgcaaaagctgaagaagatggttgataaacctacccagcgctcagtgagcaatgcagcaacgcgggtgtgccgcaccggaagatcccggtggagagacgtgtgtcggaacttcatgagacggtaccaatcaagagtgactcagggtctggtcgcgggggaaaccgcacagcagatctgcgaggacctgcgg

SEQ ID NO: 33001 - DNA, 288 bp, Artificial Sequence
  Description of Artificial Sequence: Synthetic coding sequence
atggctacctgggctttgttgctgctcgcagcgatgctccttggtaacccaggtcttgtattctccggacgtgactatcgaacttgccttactattgtgcaaaagctaaaaaagatggtggataagccaacacagcggtccgtttccaatgcagccactcgtgtttgtaggaccgggaggtccaggtggagggatgtttgtcgtaatttcatgcgtaggtaccagtccagggtaacccagggtttggttgccggagaaactgctcaacagatctgtgaagacctccga

SEQ ID NO: 33002 - DNA, 288 bp, Artificial Sequence
  Description of Artificial Sequence: Synthetic coding sequence
atggcaacatgggcacttctgttacttgctgcaatgctacttggaaatccagggctagtgttttcagggcgggattacaggacttgtctcactatcgtccaaaaattaaagaaaatggtcgacaaacccacacagcggagtgtgtctaacgcagctacacgcgtatgtagaacagggaggtccagatggagggatgtttgtagaaattttatgcgtaggtaccagtctcgggtcacacagggactggtagcaggagaaacagctcagcagatctgcgaggatttaaga

SEQ ID NO: 33003 - DNA, 288 bp, Artificial Sequence
  Description of Artificial Sequence: Synthetic coding sequence
atggctacctgggcactccttctgctggccgccatgctcctcggtaatccagggctggtgttttccgggagggactaccggacgtgcctgaccatagtgcaaaaacttaagaagatggtggacaaacccactcaaagaagcgtcagcaacgccgcaacgagagtctgtcgaaccggtagaagcaggtggcgggatgtgtgtcggaacttcatgaggagataccagtcgagagtgacccaaggccttgtggctggagaaaccgcacaacaaatttgtgaagatctgcga

SEQ ID NO: 33004 - DNA, 288 bp, Artificial Sequence
  Description of Artificial Sequence: Synthetic coding sequence
atggcaacttgggcactgctcctcttggccgccatgttactgggcaatcctggactagtgttctctgggagggactatagaacctgcttgacaattgtccagaagctgaaaaaaatggtggataagcctacgcagcggagcgtcagtaacgcggcaacgcgcgtctgccggacgggtagaagtcgctggcgtgatgtgtgccgcaattttatgcgacggtaccagtcgcgagtcacccagggcttggttgcgggcgagacggctcaacagatctgcgaggatcttcgg

SEQ ID NO: 33005 - DNA, 288 bp, Artificial Sequence
  Description of Artificial Sequence: Synthetic coding sequence
atggccacctgggctctgctgctgctggcagcaatgctcctggggaatcccggcctggtcttcagcggccgggactaccgaacatgcctcacaatcgtgcagaaactcaagaaaatggtggacaagccaacgcaaagatcagtgagcaatgccgcaaccagggtgtgccggaccgggcgctcaaggtggcgtgatgtgtgccgaaatttcatgaggcggtaccagtcccgtgtcactcaaggactcgtcgctggcgagaccgcccaacaaatctgtgaagatctgagg

SEQ ID NO: 33006 - DNA, 288 bp, Artificial Sequence
  Description of Artificial Sequence: Synthetic coding sequence
atggccacatgggcactgctgcttctggccgccatgctgctggggaatcctgggctggtcttcagcggtcgtgattataggacctgtctgacaatcgttcagaaattgaagaaaatggtggataaacccacccagagaagtgtttctaacgccgcgacccgagtgtgtcgtaccggacgttccaggtggcgggacgtatgccgaaactttatgcgcagatatcagagtcgtgtaacccagggcctagtggcaggcgagacagcccagcagatatgtgaggatctgcgg

SEQ ID NO: 33007 - DNA, 288 bp, Artificial Sequence
  Description of Artificial Sequence: Synthetic coding sequence
atggcgacctgggccctgttgctactcgcagctatgctgctcggtaaccccggcctcgttttctcgggtcgtgactaccgtacctgcctgacgatcgtccagaaactaaagaagatggtcgacaagcccacacagcggtcggtgtccaacgctgctacgcgggtgtgccgcactggccgcagcagatggcgtgacgtttgtcgcaacttcatgcgtcgataccagagtcgtgttactcaggggttggtcgccggggagaccgcgcagcaaatttgtgaagacttgcgc

SEQ ID NO: 33008 - DNA, 288 bp, Artificial Sequence
  Description of Artificial Sequence: Synthetic coding sequence
atggccacgtgggcattgcttctgcttgcagcaatgctcctgggcaatccggggctcgtgtttagcggtcgagactaccgtacctgtctcaccattgtgcaaaagctgaagaagatggtggataaacccacgcagaggtccgtctcgaatgcagcgactcgagtgtgtaggaccggacgcagccgctggagagatgtgtgccgaaatttcatgcgaagataccagtcacgggtcacccagggactggtggcgggcgaaaccgcccaacaaatatgcgaagatctgcgg

SEQ ID NO: 33009 - DNA, 288 bp, Artificial Sequence
  Description of Artificial Sequence: Synthetic coding sequence
atggctacgtgggcgctgctgctgctcgctgctatgctgcttggaaaccctggtcttgtcttctcaggaagggattacaggacatgtctgaccatcgttcaaaaactgaagaaaatggtggacaagcccactcagaggagcgtcagcaacgccgctacaagggtgtgtaggacgggtaggagcagatggagagatgtctgcagaaacttcatgaggcgctaccaatcccgcgtgacccagggccttgttgcaggtgaaacggcacagcaaatctgtgaggatcttagg

SEQ ID NO: 33010 - DNA, 288 bp, Artificial Sequence
  Description of Artificial Sequence: Synthetic coding sequence
atggctacgtgggccctgctgttactggcggctatgttgcttggtaatccaggtctggtgttttcaggacgggactaccgaacttgtcttaccatcgttcagaaactgaaaaagatggtagataagccgacccagcgatccgtctcaaatgctgccactcgcgtgtgcagaactggccgcagccggtggagggacgtttgtagaaactttatgcgcagataccaaagcagagtgacacagggtctggtggctggtgagaccgcgcagcagatctgcgaagatctgaga

SEQ ID NO: 33011 - DNA, 288 bp, Artificial Sequence
  Description of Artificial Sequence: Synthetic coding sequence
atggcaacctgggcactgctgttattagccgccatgctgctcggcaaccctgggctcgtctttagcggacgagactataggacctgcctgacaattgttcagaagctgaagaagatggtcgataagcctacacagaggagcgtcagtaacgcggcaacacgggtatgtagaacagggagaagtcggtggagagatgtctgccgcaattttatgaggagataccagtctcgggtgacccaggggcttgttgcaggcgagacagcccaacagatttgtgaggatttgcgc

SEQ ID NO: 33012 - DNA, 288 bp, Artificial Sequence
  Description of Artificial Sequence: Synthetic coding sequence
atggctacctgggctctcctgctccttgcagcaatgctgctaggtaacccaggactggttttctcaggcagggactatcgcacttgcttgaccatagtgcagaagctgaaaaagatggtggataaaccaacccagaggagcgttagtaatgctgccacccgggtctgccggaccgggcgatcccgatggcgcgacgtgtgccggaattttatgcgccggtatcaaagtcgggtaacacagggtctggtggccggggaaacggcccagcaaatttgtgaggaccttcgc

SEQ ID NO: 33013 - DNA, 288 bp, Artificial Sequence
  Description of Artificial Sequence: Synthetic coding sequence
atggccacgtgggcactgctcttgctagccgcaatgctgctcggcaaccctggtctcgtgttttccgggagagactaccgcacctgcttaaccattgttcagaaactaaagaaaatggtggataagcccacgcagagatccgtaagcaacgcagccacaagggtttgcagaacaggacgcagtcgttggcgtgacgtctgcagaaacttcatgcgccggtaccaatcccgagtgacgcaggggctggtggcaggcgagacggcccagcagatttgcgaggatttgaga

SEQ ID NO: 33014 - DNA, 288 bp, Artificial Sequence
  Description of Artificial Sequence: Synthetic coding sequence
atggcaacctgggccctgctgctacttgctgccatgctcctgggcaatcccggccttgtgttctccgggcgggattacaggacatgtcttacaatcgtccaaaaactcaaaaaaatggtggataaacctacacagcggtctgtatcgaatgctgcaacacgtgtctgtcggaccgggagatctcgatggagggatgtatgccgcaacttcatgagaaggtaccagtcgcgagtgacccagggcctcgttgctggcgaaaccgctcagcagatttgtgaggacctgagg

SEQ ID NO: 33015 - DNA, 288 bp, Artificial Sequence
  Description of Artificial Sequence: Synthetic coding sequence
atggcgacttgggcgctcctgcttctggccgccatgctcctgggtaacccaggactggtgttctcaggaagggactaccgcacttgcctgaccatcgtccagaaacttaagaagatggtcgataaacctactcagcgctctgtctccaatgcggcaacccgcgtctgtcgcaccggacggagccggtggcgagacgtgtgtcgcaacttcatgcgccggtatcagagccgcgtgacccaaggactggtggcaggcgagactgcgcagcaaatctgcgaggatttgcga

SEQ ID NO: 33016 - DNA, 288 bp, Artificial Sequence
  Description of Artificial Sequence: Synthetic coding sequence
atggcgacatgggctctgctgcttctcgcggcgatgctcctcggcaatcccggcctggtgttttcgggacgggattaccgcacatgcctgactatcgtacagaagctgaaaaaaatggttgacaagccgactcagcggagcgtgagcaatgccgccacgcgcgtgtgtcgtacaggtcgcagccgatggcgcgatgtgtgtcgaaacttcatgcgccgttaccaatcacgggtgacgcagggcctggtggccggtgagacagctcagcaaatttgcgaggatctgaga

SEQ ID NO: 33017 - DNA, 288 bp, Artificial Sequence
  Description of Artificial Sequence: Synthetic coding sequence
atggcaacatgggcccttctccttctggctgcgatgcttctggggaatcctggacttgtcttttccggtagggactatagaacatgcctgacaatcgtgcagaaactgaagaagatggtcgacaagccaacacagcggtcagtctccaacgccgcaactcgggtgtgccgtactggtaggagtcgctggagagatgtctgcaggaacttcatgcgcagataccagagtcgagttactcagggcctggtggccggggagaccgcgcaacagatatgtgaggacttgcga

SEQ ID NO: 33018 - DNA, 288 bp, Artificial Sequence
  Description of Artificial Sequence: Synthetic coding sequence
atggcaacctgggcgctgttactcctagcagctatgttattgggcaatcccgggctagtctttagtggtagagattatcgtacgtgcctgacaattgtccaaaagttaaagaaaatggtggacaagcccacccagcgctccgtgtcaaatgcagcaactcgggtttgtagaaccggccgctcccgctggagagacgtgtgcaggaactttatgcggcgttatcagagtagagttacccaagggttagtggccggagaaactgctcagcagatatgcgaagacttgaga

SEQ ID NO: 33019 - DNA, 288 bp, Artificial Sequence
  Description of Artificial Sequence: Synthetic coding sequence
atggcaacttgggctttgctgctgcttgcggcaatgcttctcggtaaccctggacttgtcttttcgggtagagactacagaacttgcctgaccatcgtgcaaaagctgaaaaagatggtcgacaagcctacccagcgctcagtttctaacgcagcaaccagagtctgtcgcaccggtcgatcgagatggcgcgatgtgtgtagaaatttcatgcgccggtaccaatcgagggtgactcagggtctggtggcgggtgaaactgcacagcaaatttgtgaagatctcaga

SEQ ID NO: 33020 - DNA, 288 bp, Artificial Sequence
  Description of Artificial Sequence: Synthetic coding sequence
atggccacctgggctttgcttcttttggccgcaatgctcttgggaaaccctggactggttttttcgggtagagattaccgcacttgtctgaccattgtccaaaaactcaagaagatggtggataagccaactcagcggtccgtgtcgaacgctgcgacccgcgtttgccgcactgggcgatcacggtggagggatgtgtgtcgaaatttcatgcgtaggtaccaaagccgagtgacccaaggccttgtcgcgggtgaaacggcacagcagatctgtgaggaccttcgc

SEQ ID NO: 33021 - DNA, 288 bp, Artificial Sequence
  Description of Artificial Sequence: Synthetic coding sequence
atggctacttgggctttattacttttagctgcaatgcttcttggtaatccaggacttgttttttctggtcgtgattatagaacatgtttaactattgttcaaaaattaaagaaaatggtagataaacctacacaaagatcagtttcaaatgcagcaactagagtgtgtcgtactggacgatctagatggagagatgtttgtcgtaactttatgagaagatatcaatcaagagtcacacaaggattagttgcaggagaaacagcacaacaaatttgtgaagatcttaga

SEQ ID NO: 33022 - DNA, 288 bp, Artificial Sequence
  Description of Artificial Sequence: Synthetic coding sequence
atggcaacctgggcccttcttttgctcgcagccatgctgttgggaaacccaggtcttgtcttttcaggtcgggattacaggacctgtcttactatcgtgcagaagctgaaaaagatggtggacaaacctactcaaagatcggtaagtaatgccgctacgagggtctgtcgcaccggccgctccagatggcgggatgtgtgccggaactttatgcgcagataccagtcgcgtgtcactcaaggactcgtggctggagaaaccgcgcagcaaatttgtgaggatttgaga

SEQ ID NO: 33023 - DNA, 288 bp, Artificial Sequence
  Description of Artificial Sequence: Synthetic coding sequence
atggcaacctgggcacttctccttctggcagcgatgttgctgggcaaccctgggcttgtcttttcaggtcgtgattacagaacttgtcttactatcgtacagaagctcaagaagatggtggataaaccgacccaacgctctgtctcgaatgccgctacccgggtgtgccgaaccggaagatcacgttggagagacgtctgtagaaacttcatgagaagataccagtccagggtgacgcagggcttggtagccggagagacggcacaacaaatttgcgaagatctcaga

SEQ ID NO: 33024 - DNA, 288 bp, Artificial Sequence
  Description of Artificial Sequence: Synthetic coding sequence
atggccacctgggcgttgcttctgctcgctgcgatgctcctgggtaatccgggcctcgttttcagcggacgcgactaccggacctgcctcaccatcgtgcagaagttgaagaaaatggtggataagccgactcaacggagcgtttcgaatgcggcgactcgggtgtgcagaaccggaagatcgaggtggcgcgatgtgtgccgcaatttcatgcggagataccagtccagggtgacgcaaggcctggtggccggtgagacggcccagcagatctgcgaggacctgcgc

SEQ ID NO: 33025 - DNA, 288 bp, Artificial Sequence
  Description of Artificial Sequence: Synthetic coding sequence
atggccacctgggcactgctcctcctcgcggccatgctgctgggaaacccgggcctggtgttctcgggacgagactaccgtacctgcttgaccatcgtgcagaagctcaaaaagatggtggataaaccaactcagcgctcggtttccaacgccgctacgcgcgtgtgcaggactggacggtcaaggtggcgggacgtctgcaggaatttcatgcgtcgctaccagtctcgggtgactcaaggattggtcgccggggaaaccgcccaacagatctgtgaggatctgcgc

SEQ ID NO: 33026 - DNA, 288 bp, Artificial Sequence
  Description of Artificial Sequence: Synthetic coding sequence
atggcaacttgggcactgcttcttttggcagcaatgcttctgggaaacccagggctggtgttttcgggtagggactataggacttgtctgaccattgtgcaaaagctcaagaagatggtggacaagccgacccagaggtcggtgtccaatgccgcgacccgagtctgccggaccggaagaagccggtggagagacgtgtgtagaaacttcatgagacgctaccagtccagagtcactcagggactggtggcaggggagactgcacagcaaatatgtgaagatctgcgg

SEQ ID NO: 33027 - DNA, 288 bp, Artificial Sequence
  Description of Artificial Sequence: Synthetic coding sequence
atggcaacttgggctcttttgcttttggcagctatgctacttggaaaccctgggctggtgttttcagggcgagattataggacttgtcttacaattgtacagaagctaaaaaaaatggttgataaacctacacagcggtctgtatcaaacgccgctacaagggtttgtaggacagggcgctcacgttggagagatgtctgtcggaattttatgagacggtatcagtcacgggtgacacagggactagtggctggagaaactgcgcagcaaatatgtgaagatcttcga

SEQ ID NO: 33028 - DNA, 288 bp, Artificial Sequence
  Description of Artificial Sequence: Synthetic coding sequence
atggcgacttgggccctcttgctcctcgcagcaatgctgcttggaaatccaggattggtcttttctggaagggactaccgtacctgcctgactatcgtccagaagctgaagaagatggtggacaaaccgactcagcgctccgtctccaacgctgccacccgagtgtgtagaaccggcagatcaagatggcgcgacgtatgcagaaacttcatgcgccgctaccagagtcgggtgacccaaggtctggtggccggggagacggcacagcaaatctgcgaagatctccgc

SEQ ID NO: 33029 - DNA, 288 bp, Artificial Sequence
  Description of Artificial Sequence: Synthetic coding sequence
atggcaacctgggcccttttgctgctcgcggctatgctccttgggaacccgggactggtcttttcaggccgggattaccgcacgtgtctgactatcgtacagaagctgaagaaaatggtggacaagcctactcagcgctcggtgtccaacgccgccactagagtttgcaggaccggtcggagcagatggcgtgatgtctgccgcaatttcatgcgaaggtaccaatcgcgagtgacccagggcctggtggcaggagaaaccgcgcagcaaatctgcgaggacctcaga

SEQ ID NO: 33030 - DNA, 288 bp, Artificial Sequence; identical to SEQ ID NO: 33014
  Description of Artificial Sequence: Synthetic coding sequence

SEQ ID NO: 33031 - DNA, 288 bp, Artificial Sequence
  Description of Artificial Sequence: Synthetic coding sequence
atggctacttgggctctgctcctgcttgcggccatgcttctgggaaacccgggcctggtgttctccggtcgcgattacaggacctgtctgactatcgtgcaaaagctcaaaaagatggtcgacaagcctacgcaaaggtctgtgagcaatgccgccaccagagtgtgtcgcactggtaggtcccgctggagagacgtgtgccgcaatttcatgcggcggtaccagtcccgcgtgacccagggtcttgtggcaggggaaaccgcgcagcagatttgcgaggacctgcgg

SEQ ID NO: 33032 - DNA, 288 bp, Artificial Sequence
  Description of Artificial Sequence: Synthetic coding sequence
atggcaacatgggcgctgctgcttctcgcagctatgttgcttggcaatccaggacttgtattcagcggccgcgattatcggacctgtttgaccatagtgcagaagctgaagaagatggtagacaagcccacccagaggtcagtgagcaatgccgccacccgtgtctgcaggactgggcgttcacggtggagagacgtatgccggaacttcatgaggagatatcagagcagagtaacacaggggttagtggcgggtgaaactgctcagcagatctgcgaagaccttaga

SEQ ID NO: 33033 - DNA, 288 bp, Artificial Sequence
  Description of Artificial Sequence: Synthetic coding sequence
atggctacttgggccctgcttcttttagcggctatgttactcggcaaccctggactggtgttttctggtagggactacaggacttgtctgacgatcgtgcagaaactgaaaaaaatggtggataagccaacgcaaagatctgtttcaaacgctgccactcgcgtgtgtcgcaccggacgcagtcgctggcgcgacgtctgtcgcaactttatgagaagataccagagccgcgtgacccagggcctcgtggctggggagacagcgcagcagatttgcgaggatctgaga

SEQ ID NO: 33034 - DNA, 288 bp, Artificial Sequence
  Description of Artificial Sequence: Synthetic coding sequence
atggctacctgggcacttctgctactcgcagccatgctgctgggaaatcctgggctagtgttcagtggacgggattaccgaacctgcctgacaatcgtgcagaagctgaagaaaatggtggacaaacccactcagcggagcgtgtcaaacgcagccacccgcgtgtgccggaccggacgctccagatggagagacgtttgcaggaactttatgaggcgttaccaatcccgggtgacacagggacttgtagccggcgaaaccgcacaacagatatgtgaagatttaaga

SEQ ID NO: 33035 - DNA, 288 bp, Artificial Sequence
  Description of Artificial Sequence: Synthetic coding sequence
atggcgacctgggcactcctgctgctggcagccatgcttctggggaatccaggactggtgttttcaggacgggactaccgaacctgtctgaccatagtccagaagctgaagaagatggtcgataaacctactcagcgaagcgtgtcgaacgccgccactcgcgtgtgcagaactgggcgttcccgatggagggatgtgtgccgtaactttatgaggcggtaccaatcgcgggtcacccaaggacttgtggcgggagaaactgcacaacaaatttgcgaagatctgaga

SEQ ID NO: 33036 - DNA, 288 bp, Artificial Sequence
  Description of Artificial Sequence: Synthetic coding sequence
atggccacgtgggcactgctgttgttggcagcgatgctgctgggtaatccgggcctggtgttctccggccgcgactacaggacgtgcttgacgatcgtgcaaaaattgaagaaaatggtggacaagcccactcaacgctctgtgtcgaatgccgccacccgggtgtgcagaacaggccgaagccgctggcgagatgtttgcaggaacttcatgcgccggtaccagagccgagtcacgcagggtctggttgcaggcgaaactgcgcagcagatctgtgaggacctacga

SEQ ID NO: 33037 - DNA, 288 bp, Artificial Sequence
  Description of Artificial Sequence: Synthetic coding sequence
atggccacctgggcccttctcctgctggcagcaatgctcctgggaaacccgggactggtgttctcgggacgcgattacagaacctgcctcactatcgtgcagaagctgaagaaaatggttgataagccaacccagcggagcgtgtcgaacgctgcgactcgggtctgccgcactgggcgctcaagatggagggacgtgtgccggaattttatgaggcgataccaatcccgcgtgacccaaggcttggtcgcgggtgaaacggcccagcagatctgtgaggacctgcgg

SEQ ID NO: 33038 - DNA, 288 bp, Artificial Sequence
  Description of Artificial Sequence: Synthetic coding sequence
atggcaacctgggccctgctgcttttggctgccatgctgttgggcaacccaggactcgtcttttcgggtagggactaccgcacttgtctcaccattgtccaaaagctgaagaaaatggtcgataagcctactcaacggtccgtcagcaacgcggccacccgcgtgtgtagaactggtcgcagccggtggagagacgtgtgtcggaactttatgcgccggtaccagtcgagagtgacccaaggactggtcgcaggagagacggcacaacagatctgtgaagatctgcgg

SEQ ID NO: 33039 - DNA, 288 bp, Artificial Sequence
  Description of Artificial Sequence: Synthetic coding sequence
atggccacttgggcactgctgcttctggccgcgatgcttctcggcaatccagggctggtgttctctggcagagactaccgcacttgcctgacgatcgtgcaaaaactgaagaagatggtggacaaaccgacccagcggtcagtctccaacgcggcgacccgtgtgtgtcgcacgggacggtcccgctggcgggatgtctgtagaaacttcatgcgccgctaccagtcgcgggtgactcagggcctggtggctggagaaaccgcacaacaaatctgcgaggacctgcgc

SEQ ID NO: 33040 - DNA, 288 bp, Artificial Sequence
  Description of Artificial Sequence: Synthetic coding sequence
atggccacatgggcactgctgctgctcgcggcgatgctgcttggtaacccaggccttgtgttctctggtcgagactataggacttgcctgaccatagttcaaaaactgaaaaaaatggtcgacaagcccacccagcgcagcgtgtcaaatgctgcaacaagggtttgccggacaggcagaagccggtggagggacgtgtgccgaaatttcatgcgaagatatcagtctcgcgtgactcaagggctggtcgcaggtgaaactgcccagcagatctgtgaagacctccgc

SEQ ID NO: 33041 - DNA, 288 bp, Artificial Sequence
  Description of Artificial Sequence: Synthetic coding sequence
atggccacctgggccctgcttctgcttgcagcgatgctgctcgggaatccgggactggtgttctcgggaagagactaccgaacttgtctcaccatcgtgcagaagctgaagaagatggtcgacaaacccacccagcggagcgtgtccaatgcggccacgcgcgtctgtagaactggacggagccgttggcgcgacgtctgcaggaacttcatgcgcaggtatcagtcaagggtcacccagggattggtggctggcgaaaccgcacaacaaatctgcgaggatctgcgg

SEQ ID NO: 33042 - DNA, 288 bp, Artificial Sequence
  Description of Artificial Sequence: Synthetic coding sequence
atggccacatgggctctgctattgttggcagccatgcttctgggcaacccaggcttagtgttttctgggcgggattacaggacatgtctgacgattgtgcagaagctgaaaaaaatggtcgacaagcctacacaacgctccgtgtccaacgccgccactcgtgtgtgtcgtacagggagatcaagatggagagatgtgtgtcggaactttatgcggcgctatcagagccgtgttacccaaggtctcgttgctggtgagacagcgcaacagatctgcgaagatctaagg

SEQ ID NO: 33043 - DNA, 288 bp, Artificial Sequence
  Description of Artificial Sequence: Synthetic coding sequence
atggccacttgggcgttgctccttctggccgcaatgctgctggggaaccctggcctcgtgttctccgggcgggactacaggacctgtctcactatcgttcagaaactcaaaaaaatggtggacaagccgactcaaagaagcgtgagcaacgccgccacgcgggtttgtagaacaggacgctcacgatggcgagacgtctgccgcaattttatgcggcggtaccagagccgcgtgactcagggcctcgtcgcgggtgagaccgcccagcagatctgcgaggacttgaga

SEQ ID NO: 33044 - DNA, 288 bp, Artificial Sequence
  Description of Artificial Sequence: Synthetic coding sequence
atggccacatgggccctgttgctgctggccgctatgctactgggtaatcccggcctcgtgttttccgggagggactaccggacttgtcttactatcgtacagaagcttaagaagatggtagacaagcctacgcagagatctgtaagtaatgccgctacccgcgtgtgtcggacaggacggagccgatggcgcgatgtgtgtcgcaattttatgagaaggtatcaaagccgggtgactcagggcttggtggcaggagagacagcacagcagatttgtgaggatctgcgg

SEQ ID NO: 33045 - DNA, 288 bp, Artificial Sequence
  Description of Artificial Sequence: Synthetic coding sequence
atggccacatgggcactactgctactcgcggcaatgctcctgggaaatcctgggttagttttttctgggcgcgactacagaacatgtctgactattgtgcagaaactgaagaaaatggtggacaaacctacgcagcggtcggtgtcaaacgccgccactagggtgtgccgcaccggtcggagccgatggcgggacgtgtgtcgaaacttcatgcgaaggtaccagtctcgcgtgacccagggactggtggcaggggagactgcccaacagatatgcgaagacctgaga

SEQ ID NO: 33046 - DNA, 288 bp, Artificial Sequence
  Description of Artificial Sequence: Synthetic coding sequence
atggcaacgtgggccctgcttcttcttgcagccatgctgctcggaaacccaggattggtgttttcaggtcgtgactatcgtacttgccttactatagtgcagaaactgaagaaaatggtcgataagcctacccaaagaagcgtgtccaacgcggcaactcgcgtgtgtcggaccggacggtcacgatggcgggacgtgtgtagaaatttcatgagacggtaccaatcacgggtcacgcaaggtctggtggcgggcgagactgcacaacaaatttgtgaagatttgcgc

SEQ ID NO: 33047 - DNA, 288 bp, Artificial Sequence
  Description of Artificial Sequence: Synthetic coding sequence
atggcgacgtgggcgttactattattagcggcgatgctattaggtaatccgggtttagttttttcgggtcgagattatcgtacgtgtttaacgatagtacaaaaactaaaaaaaatggtagataaaccgacgcaacgatcggtatcgaatgcggcgacgcgtgtttgtcgaacgggtcgttcgcgttggcgagatgtatgtcgtaattttatgcgacgatatcaatcgcgtgttacgcaaggtctagttgcgggtgaaacggcgcaacaaatatgtgaagatttacga

SEQ ID NO: 33048 - DNA, 288 bp, Artificial Sequence
  Description of Artificial Sequence: Synthetic coding sequence
atggccacctgggcacttttgctcctggctgccatgctgctcggaaatccgggccttgtgttttccggtcgggattatagaacctgtctcactattgtgcaaaagttgaagaagatggtcgataaacctacgcagcgctccgtgtccaacgctgcaactcgggtctgtcgaactgggagatcccggtggcgagacgtttgtcggaacttcatgagaaggtaccagtcacgggtgacccaaggactcgtggcaggtgagacggcgcaacagatctgcgaggacctccgc

SEQ ID NO: 33049 - DNA, 288 bp, Artificial Sequence
  Description of Artificial Sequence: Synthetic coding sequence
atggccacatgggcactcctgctgctcgccgccatgttgctcgggaaccccggcttagtattctccggaagagattaccggacatgcctcaccatcgtccagaagctgaagaagatggtcgacaagcccactcagaggtccgtgtctaatgctgctactagggtctgcagaacaggaaggtctcggtggagagacgtgtgcagaaacttcatgaggcgatatcagtctcgagtgacacagggactggtggctggcgaaactgcacagcagatctgcgaggacctaaga

SEQ ID NO: 33050 - DNA, 2478 bp, Artificial Sequence
  Description of Artificial Sequence: Synthetic coding sequence
atggagggagctgggggagctaatgacaagaagaagataagttctgaaagaagaaaggaaaaatctcgagacgctgcacgatccagacgcagcaaggaatccgaggtattctatgagttggctcaccaacttccactaccacacaacgtcagtagccatttagataaagcatcagtcatgagactgactatctcttacctgcgagtgaggaaactgctggatgcaggagacttggacatcgaagatgatatgaaagcgcaaatgaattgcttttacttgaaagctttagacggatttgtcatggtcttgaccgacgacggggacatgatctacattagcgataatgtcaacaagtacatggggctgacacagtttgaattgaccggccacagcgtatttgacttcacgcacccctgtgaccacgaagagatgcgagagatgcttacccataggaacggcctggtgaaaaaggggaaggagcaaaatacgcagcgcagcttcttcctacggatgaagtgtaccctcacctcaagaggcagaacaatgaacattaagagtgctacctggaaagtcttacattgcactgggcatatccacgtgtacgacacgaacagtaatcaaccgcagtgtggatacaagaagccgccaatgacctgtctggtcttaatctgtgaacccatccctcatccgagtaatatcgaaatcccactagacagtaaaaccttcctgtcgaggcactccctggatatgaagttcagttattgcgacgaaaggattaccgagcttatgggctatgagcccgaggaactgctggggaggtcaatttacgagtactaccatgccctggatagcgatcacctaacaaaaactcaccatgatatgttcactaaggggcaggtcacaactggacagtaccgaatgctagccaaaaggggcggctacgtgtgggtggagactcaggccaccgtcatctataatacaaagaactcccagccacagtgcatcgtgtgcgttaattatgtcgtaagtggcatcattcagcatgacctaattttctcgcttcagcagaccgagtgtgtgctcaaacccgttgagagttcagatatgaagatgacgcagcttttcactaaagttgaatccgaggatactagttccctattcgacaagctgaagaaggaacctgacgctctcactctgctcgctcctgctgctggagacacaattatttctctagatttcggatccaacgatactgaaaccgatgatcaacagttggaggaggtgccactatacaacgacgtgatgctcccttccccgaacgagaaactccagaatatcaacctggcaatgtctcccctgcccactgctgagacaccaaaaccgctgcgaagtagtgcagatccagctttaaatcaggaagtcgcccttaagctcgaaccgaacccagagtcactcgagctcagctttactatgccccaaattcaggaccagactccatctccaagcgacggatccacgaggcagtcgagtcccgaacccaattctccttcagagtactgcttttatgtcgatagcgatatggtcaatgagtttaaactcgagctcgtggagaagctgttcgccgaagataccgaggctaaaaacccattctccacacaagacaccgatcttgacctagaaatgctggctccatacattcccatggatgatgatttccagctgagatcgttcgaccaactgagcccacttgagtcatccagtgcgagccccgagagtgcctcaccgcaatctacagtgacggtttttcagcagacacagatacaggagcccacagcaaacgcgaccacaaccacagccaccaccgacgaacttaagactgttactaaagacaggatggaggatatcaaaatcctgatcgctagtccctcacccactcatatccacaaggagacaacatcggctaccagctccccttaccgggacacccagtccaggacggcaagtcccaacagagccggcaagggagtgatcgaacagacagagaagtcacatcctcgatcaccgaacgtcttaagcgtggcactcagccaaagaacgaccgtgcccgaggaggaactaaatcccaagatcttggctcttcaaaacgcccagcgaaaacgcaaaatggagcacgacgggagcctgttccaggcagtgggcatagggaccttgctccaacagccagacgaccacgcagcgaccactagcctctcctggaaaagggtgaagggatgtaagagctccgagcagaacggtatggagcagaaaactattatcttaatccccagtgatctagcatgtcggctgctgggccagtccatggacgaatccggcttacctcagctgactagctacgattgtgaggtcaatgcaccgatccagggatctcggaacctgctacagggcgaggaactcctaagagcactggaccaggtgaat

SEQ ID NO: 33051 - DNA, 2478 bp, Artificial Sequence
  Description of Artificial Sequence: Synthetic coding sequence
atggagggtgctggtggggcgaacgacaagaaaaaaataagcagcgagcggagaaaggaaaagagccgggacgccgccagaagccgaaggagcaaagaatccgaggtcttttacgagctcgcccaccagctgccgctgccccacaacgtctcttcacatctggacaaggcgagcgtgatgcgtctgaccatctcctacctgcgcgtccggaagctgctcgatgcaggagacctggatattgaggatgacatgaaggcccagatgaactgcttttacctgaaggccctcgatggctttgttatggttttgacggacgatggcgatatgatctatatcagcgataatgttaacaaatatatgggactgacacagttcgaattgacgggccactccgtattcgatttcacccatccctgtgaccacgaagagatgcgggagatgctaactcatcgcaatggcctggtaaagaaagggaaagagcagaatactcaaagaagcttttttctgcgcatgaaatgtacgctcacatctcgaggccgcacgatgaacattaaaagcgctacatggaaggtgctgcactgtacaggacatatccacgtgtacgacaccaattcgaaccaaccgcaatgtggttataagaagccaccgatgacgtgcttagtgctcatctgtgagcccatcccccaccctagcaatattgagattcctcttgattccaagacatttctaagcagacactccctggacatgaagttctcctactgcgacgaacgtatcacagagctgatgggctatgaaccagaggagctcctgggccgtagcatctacgagtactaccatgcgctggacagtgatcatctaaccaagacgcaccatgatatgtttactaagggccaagttaccacgggccaataccgcatgctcgccaaacgaggcgggtatgtctgggtggagacccaagccacagtcatctacaataccaagaatagccaaccacagtgcatcgtgtgcgttaattatgtggtgagcggaatcattcagcacgatctgatttttagccttcagcaaaccgaatgcgtcctgaagccggtggaaagctccgatatgaagatgactcagctcttcacaaaggtcgagtcggaggacacttcgagcctgtttgacaaactcaagaaagagcccgacgccctgaccctgctggcgcccgcagccggcgatacgatcatatcactggatttcggatctaacgatacggagacagacgatcagcagctggaagaggtgccattgtacaatgacgttatgctgccatccccgaacgagaagcttcagaacattaacctggccatgtcaccgttacccacggcagagacaccgaaaccgctgcgatccagcgcggatccggccctcaaccaggaggtagcattgaaactcgagccgaacccggagtctctagagctaagtttcacgatgcctcaaatccaggatcagacaccttccccatccgacgggagcacccgccagtccagccccgagccgaactcgccatccgaatactgtttctacgttgattccgatatggtcaacgagtttaagctggagctggtggagaagcttttcgcggaagacacggaggcaaaaaaccccttctccacgcaggacacagatctagacctcgagatgctggccccctatatacctatggacgatgactttcagttgcgatcgtttgaccagttgtccccgctagagtctagcagcgccagcccggagtccgcctccccgcagtcgacagtgaccgtgtttcaacagacgcagatccaagaaccgaccgccaacgcgaccacgaccaccgccacaacagatgagttaaagacggttaccaaggatcgcatggaggatatcaagatcttgattgcctccccgtcgccaacacacatacataaggagactacgtcagcgacttcgtcgccttatcgtgatacccagtcgcgcacggcgtctccaaatcgggccggaaagggtgtaatagagcaaacagagaagagtcacccccgctcaccgaacgtgttaagtgttgccctgagccagcgcaccaccgtgccggaggaagaattgaaccccaagattttggccctacaaaatgctcaaaggaaacggaaaatggagcacgacggatctttgttccaggcggtgggcataggcactttattgcagcagccggacgaccatgcagccacgacctcgttgagttggaagcgcgtaaagggctgcaagtcatctgagcagaacggcatggaacaaaagacgatcatactgattccctccgacctggcttgccgtctgctcggacagtccatggatgaatcaggtctgccccagctgacctcatacgattgcgaggtgaacgcacctattcaaggttcccgcaatcttcttcagggtgaagagctgctccgagcactcgatcaagtgaat

SEQ ID NO: 33052 - DNA, 2478 bp, Artificial Sequence
  Description of Artificial Sequence: Synthetic coding sequence
atggaaggtgcgggcggcgccaatgataagaagaagatttcgtcagaaagacgcaaggagaaaagccgggacgccgcgcggagccggcgcagcaaggaaagcgaagtgttttacgagctggcccaccaactcccactgccgcacaatgtaagctcccatcttgacaaggcgtctgtgatgagacttaccatttcatatctgcgagtccgcaagctcctggacgcgggcgacctggatatcgaagatgacatgaaggcccagatgaactgcttctacctgaaggccctggatggatttgtgatggtgctgaccgacgacggcgacatgatctacatcagcgacaacgtcaacaagtacatgggactgacccagtttgaacttaccggccactctgtgttcgacttcactcacccttgcgaccatgaggaaatgcgcgaaatgctgacccaccggaacgggctcgtgaaaaaaggaaaggaacagaacactcagcggtccttcttcttgcggatgaagtgcactctgacgtccagagggcggactatgaacattaagagcgcgacgtggaaggtgctgcactgcaccggacacattcatgtctacgataccaactcgaaccaaccgcagtgcggctacaagaagccgcctatgacttgcttggtgctgatttgtgaaccaatcccgcatccgtcaaacatcgagatccctctcgattctaagacctttctgagcagacacagcctggacatgaaattctcttactgcgacgaaagaattactgagctgatggggtacgagcccgaagagctgttgggaagaagtatctacgagtattaccatgccctggattcggaccatctgactaaaacccatcatgatatgttcaccaagggacaagtcaccactgggcagtaccgcatgctggccaagcgcggagggtacgtgtgggtggagactcaagccaccgtcatatacaacactaaaaactcacagccgcagtgtattgtctgcgtgaactacgtggtgtctgggatcatccagcacgacctcatcttctcgttgcaacaaaccgaatgcgtgctcaagccagtggaatcgtccgacatgaaaatgacccagctcttcacgaaagtggagtcggaagatacttcctccctgtttgacaagctgaaaaaggagccggacgccctgaccctgctggctcctgccgctggagatactatcatctcgcttgatttcggatccaacgacacggaaactgacgatcaacagctcgaggaagtgccgctgtacaacgatgtgatgcttcctagcccgaacgagaaactgcagaacatcaacctcgccatgtcgccattgccaaccgcggaaacgcccaagccgctgaggtcgtcagcagatccagcccttaaccaagaagtggcgttgaagctcgagcccaacccagaatcactggagttgtcgttcactatgccgcagatccaggatcagaccccgagcccatctgatggttccactcgccagtcgtcaccggagccaaatagcccctcggagtactgtttctacgtggactccgatatggtgaacgaattcaaactggagctcgtcgaaaaactgttcgctgaggacaccgaagctaagaatccattctcaactcaggatactgatctggatctcgaaatgctggccccatacattcccatggacgacgattttcagctgcggtcattcgaccagctttcaccgctggagtcctcttcagcgtccccggagtcggcctcgccacaaagtaccgtgactgttttccaacaaactcagattcaagaaccgaccgccaacgcgactactaccacggccactactgatgaacttaagacggtcactaaggaccggatggaagatatcaagattctgatcgcgtcgcctagcccgacgcacatacacaaggagacgacctccgccaccagctccccatatagagacacccagtccagaaccgcaagcccgaaccgtgcgggaaagggggtgatagagcaaaccgaaaagtcccacccacgctccccgaacgtcctgtcggtggctctgtcccagaggactaccgtcccggaggaggaactcaaccctaagatcctcgcactgcaaaatgcgcaacggaaacgcaaaatggaacacgacggctcgctgttccaggcggtgggcatcggaacccttttgcagcaacctgatgaccacgccgcgactacctcgctttcgtggaagcgcgtcaagggatgcaagagctccgaacagaatggtatggagcagaaaaccatcatcctgatcccatcagacttggcctgcaggcttcttggacagtcgatggacgaatccggattgccgcaactcacctcctacgactgtgaagtgaatgcccctattcaaggatcacggaatctgctgcagggagaagaactgctcagagcactggaccaggtcaac

SEQ ID NO: 33053 - DNA, 2478 bp, Artificial Sequence
  Description of Artificial Sequence: Synthetic coding sequence
atggagggtgcgggaggagccaacgataagaaaaagatcagctcagagagacgaaaagagaagtcacgcgacgccgcacggtcgagacggtcgaaagaatccgaggtcttttacgagttggcacatcagctgccccttccccataatgtgtcgagccacctcgataaggcatcggtcatgcgccttactatttcatacctgcgtgtcagaaagctgctggacgcaggagatcttgacatagaggatgatatgaaggcacaaatgaattgtttctaccttaaggcccttgacgggtttgtcatggtgcttactgatgatggcgatatgatttacatctccgataacgtgaataagtacatgggactcactcaattcgaacttactggccattccgtgttcgattttacccatccatgcgatcacgaggaaatgagagaaatgctgacccatagaaacggtcttgttaagaagggcaaggagcaaaacactcagagatctttctttcttcgtatgaaatgcacccttacctcgaggggaagaactatgaacatcaagtcggccacctggaaggtgcttcactgtaccggtcatatccacgtctatgatactaactcaaaccagccccaatgtggatacaagaagcctcccatgacttgcctggtgcttatctgtgaaccaatccctcacccctctaacattgaaatccccctcgactcgaaaacctttttgtcgaggcactccctggatatgaaattcagctactgtgatgagaggatcactgagctgatggggtacgagcccgaagaacttcttggcagatctatctacgaatactaccatgcccttgactcggaccacctgactaagacccaccatgacatgtttactaaaggacaagtcaccacgggtcaataccgcatgctggcgaagagaggaggctatgtgtgggtggaaactcaggcaactgtgatttacaatactaaaaacagccagcctcagtgtatcgtgtgcgtgaactatgtggtgagtggaattatccagcatgatctgattttctccctccaacagaccgagtgcgtcctcaaacccgtggaaagcagcgacatgaagatgacccagttgtttacgaaagtggagtcggaagatacttccagcctgtttgacaagctgaaaaaggaaccggatgcactgacccttctggcacctgcggcgggagacactatcatttcgctggatttcgggtcaaacgacaccgaaactgatgatcaacaactggaggaagtgcctctgtacaacgatgtgatgctgccctcacctaacgaaaagctccagaacataaaccttgctatgtcgcccctgcctactgcagaaaccccaaagccactgagatcctccgcagacccagccctgaaccaggaagtcgcactgaagttggaaccaaaccctgaatccctggaactgtcctttactatgcctcagattcaagaccagacgccctctccttccgatggatcgactcggcaaagttccccagaacccaattcgccgtccgagtactgtttttacgtggattccgacatggtcaacgagtttaagctggagttggtcgaaaaactgtttgccgaagataccgaggccaagaaccctttttccacgcaagacaccgatcttgacctcgaaatgctggctccttacattccaatggatgatgattttcagcttagatcttttgaccagctcagcccactcgaatcgtcctccgcaagcccagaatccgcgtccccccagtcgaccgtgaccgtgttccaacaaacccagatccaagaacccactgcaaacgcaaccaccaccactgcaactacggacgagctcaagaccgtgaccaaggacagaatggaagatatcaagatattgatcgcaagcccttcgcctacccacattcataaggaaaccacctcagcaacttcgagcccctacagagacacgcaatcgcggactgcatcacctaacagagcaggaaagggagtgattgaacagactgaaaagtctcatcctcgaagcccgaacgtgctgtcagtcgcgctgagccaacgtaccacggtcccagaagaggagcttaatcccaagatactggcactgcaaaatgcgcaacgcaagaggaagatggagcacgatggttcactcttccaggcggtgggaataggtactcttcttcaacaacccgatgatcatgcggccaccacctctcttagctggaagcgcgtgaagggttgcaagtcgtcggaacaaaatggtatggagcaaaagacgataattctgatcccatccgatctggcctgccgcctgttggggcagtcgatggatgagtccggccttcctcaacttaccagctacgattgtgaagtgaacgcacctatccagggttccagaaacctgctgcaaggggaagagctcttgagagcactcgaccaagtgaac

SEQ ID NO: 33054 - DNA, 2478 bp, Artificial Sequence
  Description of Artificial Sequence: Synthetic coding sequence
atggagggagcaggaggggcaaatgataaaaaaaagatttcttcagaacggagaaaggagaagtctcgcgatgccgctaggtccagaaggagtaaagaatcggaggtattttatgaacttgcccatcagctgcctctcccacataatgtgtcctcacacctcgataaagctagtgtaatgcggctgactatctcgtatctccgggtgcgaaaactgttagatgccggggatctggatatagaagatgatatgaaagcccagatgaactgcttctatttaaaagctctggacgggttcgttatggtgcttactgatgatggagatatgatatatatcagtgataacgttaacaaatatatgggacttactcagttcgaacttacaggacattcggtattcgattttacgcatccttgtgatcacgaggagatgagagaaatgttgacacatagaaacgggctagttaaaaaggggaaagaacagaacactcagcggtctttcttcttgcggatgaaatgcacacttacttcaagaggacgcacaatgaatatcaagagtgcaacatggaaagtcctccattgtactggacatattcacgtgtacgacactaattccaaccagccccagtgtgggtataagaaacctcctatgacttgcctggttctcatctgcgagccaattcctcacccttccaacattgaaataccactggactccaaaacattcctatcaaggcatagtctcgatatgaaattttcctattgtgatgaacggatcacagaattaatgggatacgaaccagaagaattgttggggagaagtatttatgaatattaccacgctttagattccgatcacctcacaaaaactcatcacgatatgtttactaaaggacaggttactactggacagtatagaatgcttgctaaacgagggggatatgtttgggtcgaaacacaggccactgttatctataacacaaaaaactcccagccccagtgtattgtgtgtgtgaattatgtagtcagtggaatcattcagcacgatctcatattctctctgcagcaaacagaatgtgtgctcaaaccagtggaaagtagtgatatgaaaatgacacagctcttcactaaagttgaatccgaggatacatcttctctgtttgacaaactcaaaaaggaacccgatgcacttacacttctcgcacccgcagctggagatacaatcataagtctagatttcggaagtaacgatacagagacagatgatcagcagctggaagaggtccccctttataatgatgttatgttgcctagtcccaacgaaaaattacagaacatcaatttagctatgtccccattgcccacagcagaaacacccaaaccactgcggtcctccgcagaccccgctcttaatcaggaagtcgcactcaaactggagccaaatcccgaaagtttagagctcagttttactatgccacagatacaggatcagacaccgtctccctctgatgggtcaactcggcagtcctctccagaacccaattctccgtcggagtactgcttttatgtcgatagtgacatggtgaacgagtttaaacttgaattggtggaaaaactgttcgccgaggatactgaagccaaaaatcccttttcaacacaggatactgacctggatctggaaatgctggccccctatatacctatggacgatgactttcagctccgctcatttgatcagctctctcctctggaatcctcatccgcttcccccgaatctgcctcccctcagtcaactgtgacagtgttccaacagacacagatccaggagccaacagcaaatgcaacgactacgacagcaacaactgatgagctcaagacagtgacaaaagatcggatggaagatatcaaaatacttatcgcctctccatcccccacacatattcataaagaaactacatctgcaactagttctccttatcgggatacacagtctcgaactgcgtcgccaaatagggccggaaaaggggtgatcgaacagacagaaaaatctcatcctagatcccccaacgttctttccgttgccctctctcagcgcactacagtgccagaagaagaactgaaccctaaaatccttgccttgcaaaacgcacagcggaagcgaaaaatggaacatgatggatcactcttccaggcagtcgggattgggacactcctccagcaaccagatgatcacgcggctactacatctctttcgtggaagcgcgtcaaaggatgtaaatcttcagaacagaatgggatggaacagaaaacaattatcctgatcccatctgatcttgcttgtcgcctgcttggacagtcaatggatgagagtggactgccccagctgacatcctatgattgtgaagtcaatgcccctatccagggatccaggaaccttctgcagggggaagaactactccgagctctcgatcaggtcaat

SEQ ID NO: 33055 - DNA, 2478 bp, Artificial Sequence
  Description of Artificial Sequence: Synthetic coding sequence
atggaaggcgccggaggggccaatgataagaagaagatctcatcagagcggcggaaggagaagagccgggacgcggcgcgatccaggagatcgaaggaatcagaggttttctatgaacttgcccatcagctgccgttgccgcacaatgtgtcgtcacatctggacaaggcctcagtgatgcggttgacgataagctacctgagagtgcgtaagttgctggacgccggtgacttggacattgaggatgacatgaaggcacagatgaactgtttctacctgaaggcgctggatggattcgtgatggtgcttaccgacgatggagacatgatttacatctcagacaatgtcaacaagtacatgggactgacccagttcgagctgaccggccacagcgtctttgacttcacccatccatgcgaccatgaggagatgagagagatgctgactcacagaaacggactggtcaagaaggggaaggaacaaaacacgcagcggtcctttttcttgcgcatgaagtgcaccttgacctcgagaggacgaaccatgaacatcaagagcgcgacctggaaggtgctgcactgcaccggacacatccacgtctacgacaccaactccaaccagcctcaatgcggctacaagaagcctccaatgacctgcctggtgcttatctgcgaacccatcccacacccgtcaaatatcgagatccccctggactccaaaaccttcctcagcagacattccctggacatgaagtttagctactgcgacgagcgaatcaccgagctcatgggatacgagccagaagaactcctggggcggagcatctacgagtactatcatgccttggactcggatcatctcactaagactcaccacgatatgttcacgaaagggcaagtcactaccggccagtacagaatgctggctaaaagagggggatacgtgtgggtggagactcaggcgactgtcatatacaacactaaaaactcccaacctcaatgcattgtgtgtgtcaactacgtggtgagcggaatcatccagcacgatctgatctttagcctccagcagacggagtgcgtgcttaagccggtcgagtcgtcagatatgaaaatgacgcagctttttacgaaggtggaaagcgaagatacgagtagcctcttcgacaagctcaagaaagaaccagacgcactgaccctgctggctccagctgcaggagacaccatcatcagcttggatttcggctccaatgacacggaaaccgatgaccaacaactggaagaggtgccactgtacaacgacgtgatgctgccatcgccgaatgagaagttgcagaacatcaacctggcgatgtccccgctgccaactgcggagactcctaagccgctccgctcctccgccgacccagccctcaaccaggaggtcgctcttaagctggaaccgaacccagaatcactcgagctgagcttcactatgccacagatccaggatcagacgccttcgccttcagatggctccactcgccaatcctcgcctgaacctaattcgccatccgaatactgcttctacgtggattcggacatggttaacgagtttaaacttgagctggtcgagaaactgttcgcggaagatacggaggcaaagaacccattctccactcaagacaccgacctggacctggaaatgttggccccttacatccctatggacgatgattttcagctgcgctcattcgaccagctttcaccgctcgaatcctcgagcgcatcgccggagtcagcctccccgcagtcaaccgtgaccgtgttccaacagactcaaatccaagagcctactgccaatgcgactaccactacggctaccactgatgagctcaagactgtgactaaggatcgcatggaggacatcaagatcctgatcgcttccccatccccgactcacatccataaagaaactaccagcgctacctcgtccccctaccgcgatactcaatcacggactgcgtcgccgaaccgggccggaaaaggagtgatcgaacagactgaaaagtcccatccgcgctccccgaacgtgctgtcggtcgcattgtcccagcgcaccaccgtgcctgaagaagaacttaacccgaaaattcttgcgttgcaaaatgctcagcgcaaaaggaagatggagcacgacggctccctgttccaagccgtaggaatcggaacgctgctgcagcaaccggatgaccacgctgcgacgacctcactttcatggaagcgcgtgaaaggttgtaagtcctccgaacagaacggaatggagcaaaagactatcatcctgatcccgtcagacctggcctgccgccttttgggccagtcgatggacgagagcggcctcccacagctcacttcctacgattgtgaagttaatgctccgatccaaggttcccgcaatctcctccagggagaagaactgctgcgggcgcttgaccaggtgaat

SEQ ID NO: 33056 - DNA, 2478 bp, Artificial Sequence
  Description of Artificial Sequence: Synthetic coding sequence
atggagggggcaggtggagcaaacgacaagaaaaagatttcttctgagcgaagaaaggaaaaaagccgagacgcggcgcgatctagacgcagtaaggagagcgaagtgttctatgagctggcgcatcaactgcccctcccccacaacgtctcttcccatctggacaaggccagcgtaatgcgcctgaccatttcctacctgcgtgtaaggaagttgctggacgccggagatcttgacatcgaggacgatatgaaggcacaaatgaattgcttctacttgaaagccctcgatggctttgtgatggtgctcacggacgacggggacatgatttacatttcagacaacgtgaacaaatacatgggacttacccagttcgaactgacaggccattctgtttttgattttacccacccctgtgatcatgaagagatgcgggaaatgctaacgcataggaacggacttgttaaaaagggcaaggagcagaacacccagagaagtttttttcttaggatgaagtgcactctcacaagtaggggcaggacaatgaacattaagtctgccacctggaaagtgttgcattgtacagggcacatccacgtgtacgacacaaacagcaatcagccccagtgcgggtacaaaaagccacctatgacgtgtttggttctgatttgcgagcccatcccccaccctagcaatatcgagatcccgcttgactccaagacattcctttctagacattctctggacatgaaattcagttattgcgacgaacggattaccgagctcatgggctatgaaccagaggagcttctcggtcgttccatatatgagtattaccatgctctcgactcagatcacctgacgaaaacacaccatgacatgtttaccaaggggcaggtgacaacaggtcagtaccgtatgctagcaaaaaggggaggctacgtgtgggtggaaacgcaggccactgtgatttataacacgaaaaattcccagccacagtgtattgtctgtgttaactacgtggtgtccggcattatccagcatgacctgatcttttcactacaacaaacagaatgcgtgcttaagcccgtagaaagttctgatatgaaaatgacccagttgtttacaaaagtggaaagtgaggacaccagcagtctgtttgacaagctcaagaaagaacccgatgcgctgaccctgctggctccagccgctggagatacaattatttctcttgacttcggctcgaacgacaccgaaactgatgaccaacaactagaggaagtcccactctataatgatgttatgctcccaagcccaaacgaaaagttgcagaacattaacctggcgatgtcccccctcccaacagccgaaaccccgaagccacttcgaagctctgctgaccccgcactgaaccaggaggttgccttgaagttggagccaaatcccgaaagtctcgagctcagctttactatgcctcagatccaagaccagacacctagtccgtcagatggttcaactcgacagtcttcccctgagccaaacagtccatcggagtactgtttctatgtggacagtgacatggtgaacgaatttaagctggagctggtggagaagttgttcgcagaagatactgaggctaaaaacccatttagcactcaggatacggatctagacctggagatgttggccccctatatccctatggacgatgactttcaactcaggtccttcgaccagctgagccccttagagtcctcaagcgctagcccagagtccgcttcccctcaatccactgtaaccgtgtttcagcagacacagatacaagagccaacagccaatgcaactaccacgaccgccaccactgatgagctaaaaacggtgactaaggatagaatggaagacataaagatcttgatcgcgtccccttctcccacgcatatccacaaagagaccacaagcgcaacctccagcccttatcgcgatacccagtctcggactgcaagtccgaatcgggctggaaaaggggtcatcgagcagaccgaaaagagtcatcctcgaagtccaaacgtcctatctgttgcgctgagccagcggaccaccgtgcctgaagaagaactcaacccaaagatcctagctctccaaaatgcacagaggaaacggaagatggagcatgatggcagcctttttcaagctgtgggcattggcactctcctgcagcagccagacgatcacgctgccaccacaagcttgtcctggaagagggtgaagggctgtaaatcgtccgagcagaacggcatggaacagaagaccatcatattaatcccttcagacctggcttgccgactgttgggtcagagtatggacgaatcgggtctaccccagcttaccagttacgactgcgaggtgaacgcacccatacaggggagccgcaatctcctgcagggagaggagttgcttagggctcttgaccaggtcaat

SEQ ID NO: 33057 - DNA, 2478 bp, Artificial Sequence
  Description of Artificial Sequence: Synthetic coding sequence
atggagggcgcgggaggcgcgaacgataagaaaaagatcagctccgaacggcggaaagaaaagtcccgtgacgctgctagatcgcgcaggtccaaagagagcgaggtgttctacgagcttgctcaccaactgccgcttcctcacaacgtctcgagccaccttgataaggcctcagtcatgcgccttactatcagctacctccgggtccggaaactgctggacgctggcgacctcgacattgaggacgatatgaaggctcagatgaactgtttttacctgaaggccctggatggcttcgtcatggttcttaccgacgacggagacatgatctacatcagcgacaacgtcaataagtacatggggctcactcagttcgaactcaccggacactcggtgttcgactttactcatccttgcgatcacgaagagatgcgagaaatgctcacccaccggaacggtcttgtgaagaaaggcaaggagcagaacacccagcgcagcttttttctgcggatgaagtgcactctgacctcgcgcggacgcaccatgaacatcaaatcggctacctggaaagtgctccactgcactggacacatccacgtgtacgacactaactcgaatcagccacaatgcgggtacaagaagccaccgatgacttgcctggtgctgatctgcgaaccaatcccgcacccatcaaacatcgagatcccgctggatagcaagacgttcctgtcaaggcattccctggatatgaagttcagttattgcgacgaacgcatcactgaactgatgggatatgaacccgaggaactcttgggacgctccatctacgagtactaccatgcgctcgactccgatcacttgaccaagactcaccatgacatgttcaccaagggccaggtgactactgggcaataccggatgctggcgaagcgcggaggatatgtgtgggtcgaaacccaggctactgttatctacaacactaagaattcacagccacagtgcatcgtctgcgtgaactacgtggtgtccggaatcatccagcacgatctgattttctcgctgcaacagaccgaatgtgtgctcaaacctgtggaatccagcgatatgaagatgacccaactcttcaccaaagtggaatcggaggacacctcctcactgttcgataagctgaagaaggaacccgatgcgctgactctcctggccccagcggccggcgataccatcatctcgctggacttcggatccaacgacactgaaaccgatgaccaacagctggaagaggtcccgctctacaacgacgtgatgctgccatcgcctaatgagaaactccaaaacataaatctcgccatgagccccctgccaaccgcggagactcccaagccactgcgctcttcggccgatcctgccctcaaccaggaggtggccctcaaacttgagcccaatccagaatcgctggagctgtcatttaccatgccgcaaatccaggaccagacccctagcccgtcagacggcagcaccagacagtcatcacccgaaccaaactcgccatcagagtactgcttctatgtggatagcgatatggtgaacgagtttaaactggagctggtagaaaagctgttcgcggaagataccgaagcgaaaaaccccttctcaacccaggacactgacttggacctcgaaatgctcgccccgtacatcccgatggatgatgatttccagctgcgctcgttcgatcaattgtcacctctcgaatcgtcgtccgcgtccccggagagcgcgtccccgcagtcgaccgtgactgtgtttcaacagactcagattcaggaaccaactgcgaacgcaactactacgaccgcaacgaccgatgagttgaaaaccgttaccaaggacagaatggaagatatcaagatcctgatcgcaagcccctccccgactcatatccacaaggaaaccacctcagcaacctcgagcccttacagagatacccagtcccgcaccgcatcgccaaatcgcgcgggaaagggagtcatcgaacagaccgagaagtctcacccaaggtccccaaacgtgctgtcggtcgcactctcgcaaagaactactgtgcctgaggaggaactgaatcccaaaattctcgctctgcagaacgctcagcggaagaggaagatggagcatgacggatcactgtttcaagcggtcggcattggcaccctgctccagcaaccggacgatcacgctgcaacgacctcactctcatggaagcgcgtgaaaggttgtaaatcttccgaacagaacggcatggagcaaaaaacgatcattctcatcccgtccgacctggcctgtagactgcttggacagtccatggacgagagcgggttgcctcagctcacctcatacgactgtgaagtgaacgccccgattcaaggtagccggaacctgctgcagggggaagagctcctcagggcgctggatcaggtgaat

SEQ ID NO: 33058 - DNA, 2478 bp, Artificial Sequence
  Description of Artificial Sequence: Synthetic coding sequence
atggaaggagccgggggagccaacgataagaagaaaatctcgagcgaacgccgtaaggagaagagccgggacgccgcccggtcgcggcgctccaaggagtctgaagttttctacgaactcgcgcatcagctgcccttgccacataacgtgtcatcccatctggacaaggcttccgtgatgcgtctgaccatctcgtacctgcgcgtccggaagctgctggacgcaggtgacctggacatcgaagatgatatgaaggcgcagatgaactgcttctacctgaaggcgctcgacggattcgtgatggtgttgacggacgacggcgacatgatttacatctctgacaacgtgaataagtatatgggactgacccaattcgaactcaccggacattcggtgttcgacttcacgcatccttgcgatcacgaagaaatgagggaaatgctcacccaccgcaacgggctggtcaaaaagggaaaggaacagaacactcagagatccttcttcctccgcatgaagtgcactcttactagccgcggacggaccatgaacattaagagcgcaacctggaaagtgctgcactgtaccgggcacatccacgtgtacgacactaatagcaaccaaccacaatgcggttacaagaaaccgcccatgacttgtttggtcctcatctgcgagccgattccgcacccttccaatatcgagatcccgctggattccaagaccttcctgagccgacactccctggatatgaaattctcctactgcgacgagcggatcactgaactcatgggctacgagcctgaagagttgctgggtcgctcgatctatgaatactaccatgccctggatagcgatcatctgactaaaacccaccatgacatgttcactaagggacaggttaccaccggacagtacaggatgcttgcgaagcgcggcggatacgtgtgggtggagactcaggcaaccgtgatctacaatactaagaattcacagcctcaatgcattgtgtgtgtgaactacgtggtgtccggaatcattcaacacgacctcatcttctcactccaacagaccgagtgcgtgctcaaaccagtggaatcaagcgatatgaagatgacccagctttttactaaagtggagtccgaggacactagcagcctgttcgacaaactgaaaaaggaacccgacgcacttactctcctggcccccgcggcgggagataccattatctccctggacttcggaagtaacgatactgaaactgatgaccagcagttggaggaagttccactgtacaacgacgtcatgttgccgtcgccgaacgaaaaactgcagaatatcaatcttgcgatgtcgccactgccgaccgccgaaactccgaagccgctgaggagctccgccgatccggcactgaaccaggaggtcgcgctgaagctcgaacctaatccggagagcttggagctttcgttcactatgccacaaatccaagatcagaccccgagtccgtcagatggatcgactcggcagtcctcacctgaacctaattcccctagcgagtattgtttctacgtcgattcggatatggtgaatgagttcaagttggaactggtcgagaaactgtttgccgaggatacggaagcaaagaatccattttccactcaagacacggacttggacctggagatgctggccccatacatacccatggacgacgattttcagctgcgctcgttcgatcaactctcccctctggaatcctcttcagcatcgcctgaatcagcttcaccgcagtcaaccgtcactgtgtttcaacaaactcaaattcaagaacccacggcgaatgcaactaccaccacggccaccaccgacgaacttaagactgtgaccaaggatcgcatggaagatatcaagattctgatcgcttccccctcgccgactcatatccacaaggagacgacttccgcgacttcatctccgtaccgggacacgcagtcacgcactgcctcgccgaaccgggccgggaagggagtgatcgagcaaactgagaagagccacccaagatcccctaacgtcctctcggtagctctgagccagcgcaccactgtgcccgaagaagagctgaacccaaagatcttggcccttcagaatgcacaaagaaaacggaagatggaacacgatggctccttgtttcaggcggtgggaatcgggaccctgcttcaacaacctgacgaccatgcagcaacgacttcgctttcgtggaaaagagtaaagggatgtaaaagcagcgagcagaacggaatggaacaaaagaccatcatcttgatcccatccgatctcgcgtgccggctgctgggacagtccatggacgagtctgggttgccgcagctcacttcctacgattgcgaagtgaacgcccccatccagggctcacgcaatctcctgcagggggaagagctgttgagagcgctggatcaggtgaac

SEQ ID NO: 33059 - DNA, 2478 bp, Artificial Sequence
  Description of Artificial Sequence: Synthetic coding sequence
atggaaggagctggtggggccaacgataagaagaaaatttcgagcgaaagacggaaggaaaagtcaagagatgccgcgcggagccgccggtccaaggaatcggaagtgttttacgagctggcacatcagctgccactgccacataacgtatcgtcgcacctcgacaaagcgtccgtcatgaggctgaccatcagctatctcagggtgcgcaagctcctggacgccggagacttggatatcgaggatgacatgaaagcccagatgaactgcttctacctcaaagcgctggatggattcgtcatggtcctgaccgacgacggtgatatgatctacatctccgataatgtgaacaagtacatgggccttacccagttcgagctgacgggccactcagtgtttgatttcactcatccgtgcgatcacgaggagatgcgagagatgctcacccatcgcaatgggctcgtgaagaagggaaaggagcagaacacccagcgctctttctttctccggatgaaatgcacgctcaccagccggggacggactatgaatatcaagtccgcaacctggaaggtattgcactgcaccggccatatccatgtgtacgatactaactccaatcaaccgcagtgcggctacaagaagccgcctatgacctgcctggttctgatctgtgagccgatcccacacccatccaatatcgagataccgcttgactccaaaacctttctgagcagacacagcctggacatgaaatttagctactgtgacgaaaggatcacggagctcatgggctatgagcctgaggaactgctcgggcgctcgatctacgagtactaccatgcgctggattccgaccatctcacgaaaacccatcacgacatgttcaccaagggccaggtgaccaccggacagtaccgcatgctggcgaagcgagggggttacgtgtgggtcgaaacgcaggctaccgtcatctacaacacgaagaactcacaaccgcagtgtatcgtgtgtgtgaactacgtagtctcggggattatccagcacgatcttattttcagccttcagcagactgaatgcgtgctcaagccggtggaaagctcggacatgaagatgactcagctgtttacgaaggtcgagagcgaggacactagctcccttttcgataagctgaagaaggaacctgatgctctgactttgctcgcaccagccgctggtgatactataatctcgctggacttcggctccaatgacaccgaaactgacgaccagcagttggaagaggtccccctgtacaatgacgtgatgctgccgtcccctaacgaaaagctgcaaaatatcaaccttgccatgtccccgcttccgaccgccgagactccgaaaccgctgaggtcctccgcagatccagccctgaaccaggaggtggctctgaaactggaaccaaatcccgagtccctcgagctgagcttcaccatgccgcaaatccaggaccagactccaagcccgtcggacggcagtacgcgccagtcaagcccagaaccgaactcgccgtccgagtactgtttctacgttgattccgatatggtcaatgaatttaagctcgaactcgtggagaaattgttcgccgaagacactgaagcgaaaaacccgttctccactcaggatactgacttggatctcgaaatgctggccccgtacattccgatggacgacgacttccagttgaggtcgttcgaccagttgtcgcccttggaaagcagctcagcgtcaccagaatctgcctcgccgcagagcaccgtcaccgttttccaacagactcagattcaggaaccaaccgcaaacgccactactaccaccgctaccaccgatgagctgaaaactgtgactaaggaccgcatggaggacatcaagatcctgatcgcgtcaccgagccctacccacattcacaaggaaaccacctcggccacctcttcgccgtacagagacactcagtcgcggaccgcctcaccaaaccgggcggggaagggcgtgatcgagcaaactgagaagtcccatccgcgcagccccaatgtgctgagcgtggccctgtcgcagcggaccaccgtgcccgaagaggaattgaatcccaagatccttgcactgcaaaatgcccaacgaaagcgcaagatggaacacgacggatctctgttccaggcagttgggatcggaactctgctgcaacagccggacgatcacgcggcgactacgtcgctgtcgtggaagagagtcaagggctgcaaatcctcagagcagaacggtatggaacaaaagaccatcatccttatcccaagcgatcttgcctgccggctgctgggacaaagcatggatgaatccggattgccacaacttacttcctatgactgcgaggtgaacgctcctatccaaggttcgcgtaacctcctgcaaggagaggagctcctgcgcgccctcgaccaagtgaac

SEQ ID NO: 33060 - DNA, 2478 bp, Artificial Sequence
  Description of Artificial Sequence: Synthetic coding sequence
atggagggagcgggaggagctaacgataagaagaagatttcctcagaaagaagaaaggagaagtccagggatgccgctaggagccgcaggagtaaagagtctgaggttttctatgaacttgctcatcagctgcctctgccacataacgtgtctagccacctcgataaggcttcagtgatgaggctgaccatatcctatctgagagtgaggaagttgctggatgctggtgacctggacattgaggatgatatgaaggcgcagatgaattgcttctacctgaaggctttggacggctttgttatggtgttgaccgacgacggagacatgatctacatttccgataatgtgaataaatatatgggactcacccaattcgagctgacaggacacagcgtgttcgactttacccatccatgtgatcacgaggagatgagagagatgcttacccaccgcaatggtctggtaaagaaaggtaaagagcaaaatactcagcgctcattttttctgagaatgaagtgtacgctgacatctaggggccgcactatgaatataaagagcgccacatggaaggtgctgcattgtaccggtcacatccacgtgtatgataccaactccaatcagccccagtgcggatataagaagccacctatgacctgccttgtgcttatatgcgagccaattccccacccatccaatattgaaatccctttggattccaagaccttcctgtcccgccattctctggacatgaaattttcttactgtgatgaacgcatcactgagctcatgggttacgaaccagaggagctcctcggcaggtccatctatgagtactatcacgcattggactctgaccacctgaccaaaacccaccacgacatgtttaccaagggtcaggtgactacgggtcaatataggatgctggctaagagaggaggttacgtttgggtagagacacaggctaccgtgatctacaacaccaagaactcccagccccagtgcatagtgtgtgtgaattacgtggtgtccggtatcatccaacacgaccttattttcagccttcaacagactgagtgcgtcctcaagccagttgagagttcagacatgaagatgacgcagctgttcactaaggttgagagcgaggatacttcaagcctgtttgacaaactgaaaaaggagcccgatgccctcacactgctggccccagccgccggcgacactatcatatctctggacttcggctctaacgacacagaaaccgacgatcagcagctggaggaggtcccattgtacaacgatgtgatgctgccatctccaaatgaaaagctgcagaacataaacctggctatgtcaccattgcccactgctgagacccctaagcctctgagatcaagcgctgacccggccttgaaccaggaggtcgccctcaagctcgaacctaaccccgaaagcctcgaactctccttcactatgccacagatccaggatcagactccctccccatctgatggttcaacacgccagtcaagcccggagccaaactctcccagcgagtattgcttctatgtcgactcagacatggtaaacgagttcaagctggaactggtggagaagctgtttgctgaagataccgaggcgaagaatcccttcagcacgcaggacaccgacttggatttggagatgttggccccgtacatccctatggacgacgattttcaattgcgcagtttcgatcagctcagtcccttggagtcctccagcgcctctcccgagagcgcctccccccagagtaccgtcacagtgttccaacaaacacagattcaagagcctaccgctaacgccaccactacgaccgcaacgaccgatgagctgaagaccgtcaccaaagacaggatggaggatatcaagatactgatcgcttctccttccccgacccacatccacaaagaaactacttcagcaacctcaagtccatatagggatactcagtctcgcaccgcttcccctaatcgcgcgggaaagggcgtgatcgaacagactgaaaaaagccaccctcgcagcccgaatgttctgtccgtcgcactgtcacagcgcacaacagttcctgaggaagaactgaatccaaagatcctcgctctccaaaacgcacagagaaagcgcaagatggagcacgacggcagtctcttccaagcagtgggcatcggaaccctgctccaacaaccagatgaccacgctgccaccacctccctgtcttggaagcgcgtgaagggctgcaaaagtagcgaacaaaatggcatggaacaaaagaccataatactcatcccctcagatctggcatgcaggctgcttggacagtctatggacgagtcaggcctcccacagctcactagttatgattgcgaggtgaacgcccctattcaaggttcaaggaaccttttgcagggagaagaactcctccgcgccttggatcaagtcaac

SEQ ID NO: 33061 - DNA, 2478 bp, Artificial Sequence
  Description of Artificial Sequence: Synthetic coding sequence
atggagggcgccgggggagcaaacgataagaagaagatctcctcggagaggcggaaagaaaagtcccgcgacgccgctcggagccggcggtcgaaggagtcggaagtgttctacgagctggctcaccagctgcctctgccgcacaacgtgtcctcgcacctggacaaggcatcggtgatgaggttgaccatctcgtatttgcgcgtccggaagttgctggatgcgggcgacctggatatcgaagatgacatgaaggcccagatgaattgcttctacctcaaggcactggatggcttcgtcatggtgctcacggatgacggcgacatgatctacatctcggataacgtgaacaagtacatgggcctcacccagttcgagctgaccggccattccgtgtttgacttcacccatccgtgtgatcacgaagagatgcgggaaatgctgactcaccgcaatggactggtcaagaaggggaaggagcagaacacccagcgctccttcttcctgcggatgaagtgcactctgacttcaagaggcaggacgatgaatatcaagtcggccacctggaaggtcctgcactgcactggtcacatccacgtgtacgacaccaactcgaatcagccgcagtgcggatacaagaagcctccgatgacttgcctcgtgctgatctgcgaaccgattccacatccttcgaacatcgagatcccactggactccaagacttttctctcaagacatagcctggatatgaaattcagttactgcgacgagcggatcactgaactcatgggttacgaaccggaagaattgctgggccgttctatctacgaatactaccatgcgctcgactcggaccatctgactaagactcaccatgacatgttcactaagggacaagtgacgacgggacaataccgcatgctggcgaagcgagggggatacgtgtgggtggaaactcaagccaccgtgatctacaacaccaagaactcccagccgcaatgtatcgtgtgcgtgaactacgtggtgtccgggatcatccagcatgacttgattttctcactgcaacagacggagtgcgtgctgaaaccggtggaatcttccgatatgaaaatgactcagctcttcacgaaggtcgagtcggaggacacttcctcactgttcgacaaactgaagaaagagcctgacgcccttacgctcctggccccagcggctggagataccataatctcgctcgacttcggatcaaacgacaccgagactgacgatcagcagctggaggaggtgccgctctacaatgacgtcatgctgccgtcaccgaatgagaaacttcagaatatcaacctggctatgagcccgcttccgaccgccgaaaccccgaaaccgttgagatcctcagcggacccagcgctcaaccaggaggtggccctgaaattggagccgaacccagaaagcctggaattgagcttcaccatgcctcagattcaggatcaaaccccaagtccgtccgacggatcaacccgccagtcatccccagagccgaactccccgtcggagtactgcttctacgttgattccgacatggtgaacgaattcaaactggaactcgtggaaaaactcttcgctgaagataccgaggcaaagaatccgttcagcacccaggataccgacctggatctggagatgctggctccctacattcctatggacgacgatttccagttgcgctcgttcgaccagctctcgccactcgaatcatcgagcgcgtcgcctgaatccgcctcgccacaatccactgtcaccgtgttccagcaaacccagatccaggaaccgactgccaacgcgaccaccaccaccgccacgactgacgagcttaagaccgtcactaaggaccgcatggaggatatcaagatcctgatcgcctcgccgtcccctacccacatccacaaggaaactacttcggctacgtcgtccccttaccgggatacccagtccagaactgcctccccgaacagagcaggaaagggagttatcgagcagaccgaaaagagccacccgcggtcgccgaacgtgctctcagtggcgcttagtcagagaactaccgtgcccgaggaagaattgaacccaaagatcctggccctccagaatgcccagcggaaacggaagatggaacatgacggatcgcttttccaggccgtgggtattggtacgctcctgcaacagcccgacgatcacgcggcgactacctcgctgagctggaaaagagtgaagggttgcaagtcatccgaacagaatgggatggaacaaaagaccatcattttgattccatccgacctggcgtgcagactgctgggacagtcgatggatgaatcagggctgccccaactcacttcctacgactgcgaagtgaacgcgcctattcaaggatcgcgaaatctgctgcagggagaagaactcctgagagctctggatcaggtcaac

SEQ ID NO: 33062 - DNA, 2478 bp, Artificial Sequence
  Description of Artificial Sequence: Synthetic coding sequence
atggaaggggcaggcggtgcgaacgataagaaaaaaatctcatcagagcggagaaaagagaaaagtagggacgcggctagatcacggaggagcaaagagtctgaagtcttttacgaactggcccaccagctgcctttaccacacaacgtcagttcacacctggacaaggccagcgtgatgagacttacaatcagctacctccgcgtcagaaaactgttagatgcaggcgatttggacattgaggacgacatgaaggcgcagatgaactgtttttatctcaaggcgctggatggatttgttatggttttgaccgacgatggagatatgatctacatctctgataatgtgaacaaatatatggggttaacccagttcgagcttactggacattctgtctttgatttcacccacccttgtgatcacgaagagatgcgagagatgctgacgcacagaaacgggctagtcaaaaaaggtaaagagcagaatacccagagatctttcttcctaaggatgaaatgcaccctgacctcacggggccggaccatgaacattaaatctgccacatggaaggtgttgcactgcacgggacatatccacgtgtatgacaccaattcaaatcagcctcaatgtggctataagaaaccgccgatgacctgcctggtgcttatctgtgagcccattccacacccttctaacattgagatccctctcgattctaaaaccttcctgagtagacattccctggacatgaaatttagctattgtgatgaacgcatcacagaactgatggggtacgaaccagaagaactcctggggcgcagcatctacgaatattatcacgcattggacagcgatcacctgacaaaaacccatcacgacatgttcacaaagggacaggtaacgaccggccagtacagaatgttggcaaagagagggggatatgtttgggtggaaactcaggccacggtgatatacaatactaaaaacagccaaccacaatgcatcgtgtgcgttaactatgtggtaagtgggataatccagcacgatttgatattctccctgcagcagactgagtgtgtgctgaaacctgtcgaatcatccgacatgaaaatgacccagttattcacgaaggtcgaaagtgaagatacctcgagtctgtttgataagctcaagaaagagcccgacgcgttgactctccttgctcccgccgcaggagatactatcataagccttgattttggctccaacgatacagagaccgatgaccaacagctggaggaagtccccctctataacgatgtgatgctgccgagccccaacgagaagctccagaatataaatctggccatgagccccctgcccaccgcagaaacacccaagccattaagatcatctgctgaccccgccctgaatcaggaggtggctttgaagctagagcctaaccctgagagcctggagctgagtttcaccatgcctcaaatccaggatcagacacccagtccctcagacggaagtactcggcagtcctcccccgaacctaattctccgtctgaatattgcttttatgtcgattcggatatggtaaacgagttcaaactggaactagtggaaaaactctttgccgaggacacagaggccaaaaatcctttctccacccaggatacagacttggacctagagatgctggccccctacatccctatggatgatgactttcagctgagatccttcgatcagctgtcgccacttgagagcagctccgcgagccccgagagtgcttccccccagtcaacagttacagtgttccaacagacacagatacaggagccaactgctaatgctactactactacggcaactacggatgaactcaaaacagtcacaaaggatagaatggaggacataaagattttgattgcatcaccgtctccaacgcacattcacaaagaaacaactagtgcaacctcttccccctaccgggatactcaaagcaggaccgccagtcccaaccgagctggcaagggcgtgattgagcagaccgaaaagtctcacccacggtcgccaaatgtgctttccgtggcgctgtcccagcgaactaccgtgccagaggaggaactcaaccccaaaatcctggcgctgcagaatgcacaacggaagcggaaaatggaacacgacggaagcctgttccaggcagttggcataggtactctcctgcagcagccagacgatcatgccgccaccacgtctctgtcatggaaaagagtgaaaggttgtaagagctcagagcagaacgggatggagcaaaaaacaataatcctgatcccatcagacttggcctgtaggctcttaggacagtcaatggatgaaagcggactgcctcagttaactagctacgactgtgaagtcaacgctccaattcagggatccagaaaccttctgcagggcgaagagctcctcagggccctggatcaggtaaat

SEQ ID NO: 33063 - DNA, 2478 bp, Artificial Sequence
  Description of Artificial Sequence: Synthetic coding sequence
atggaaggagccggaggggcaaacgataagaagaagatctcttctgagagaaggaaggaaaaatctagagacgccgcaagatcaaggcgtagcaaagaatcggaagtattctacgagctcgcccaccaactccctctgcctcacaacgtgtcgtcacacctggataaggctagtgttatgaggttgacgatcagttatctacgtgtgcgaaagttacttgacgcaggagaccttgatatcgaagatgatatgaaagcccagatgaattgcttttacctaaaagccctggacggctttgttatggtgcttacagacgatggggacatgatttatatttccgacaatgtcaacaagtatatgggactgacacagtttgagctcaccggacactcagtctttgactttactcacccatgtgaccacgaggagatgagggaaatgttgacacacaggaacggtctggtgaagaaaggtaaggaacagaacacacaaaggagcttctttctgagaatgaagtgtacgttaacaagccgggggagaaccatgaacatcaaaagcgctacctggaaagtcttacactgtacgggccacatccatgtttatgacacgaatagcaatcagccacagtgtggttacaagaaaccacccatgacttgcctcgtccttatttgtgagcctataccacatccgtctaatattgagattccgctcgattccaagaccttcctgagccgacacagtctcgacatgaaattttcctactgtgatgagcgaatcaccgagctgatgggttatgaacctgaagagctgctcggacgatccatctatgagtattatcatgccctggattctgatcatttaactaaaactcatcacgacatgtttacgaaggggcaggtgaccacgggacagtatagaatgctggcaaaaagagggggctatgtgtgggtggagacgcaggcgactgtaatctacaatacaaagaatagccagccacagtgcatagtgtgcgtgaattatgttgtaagcggaataatccagcatgacctaattttctccctgcagcagactgaatgcgtgctcaagcccgttgagtcttccgacatgaagatgacacaattattcacaaaggtggagtccgaggacacttcgtctctgttcgacaagcttaagaaagaacccgacgctttgacactgctggcacctgctgccggggacaccataatcagcctagatttcggctcaaatgatactgaaaccgacgaccagcagcttgaggaggtgcccctttacaatgatgtgatgctgcccagccctaacgaaaagctgcagaacataaatctggcaatgagccccttacccaccgcagaaaccccaaagccccttcgctctagtgccgacccagccttgaatcaagaagtggctctcaaattggaacccaatcctgaaagtctcgaattgtcttttaccatgccgcagatacaggaccagaccccgagtccaagcgacggttcaacgcgccagtcttccccagagcctaactcccctagcgagtattgcttttatgtggacagcgacatggtcaacgagtttaagctggaactggtagagaagttatttgctgaggacactgaggccaagaacccattcagcacccaggatacggatctggatctggaaatgcttgcaccatatatcccaatggacgatgacttccagctgagaagttttgatcagctgtccccactcgagtcatcatctgcttcccctgagtctgcctctcctcaatctaccgtgaccgtttttcaacagacacagattcaggaaccgacagcgaacgccacaactacaactgccacaactgacgaactgaagacggtgactaaggaccggatggaggacatcaagattctgatcgcgtcaccctcccctacgcacatccataaagaaaccacaagcgccacctcctcgccttaccgagatacacagagccgtacagcttcaccaaacagggccggcaagggagtgatagaacagactgagaagtcacaccctcgcagcccaaacgtcttatctgttgcactgagccaacggaccactgtccccgaggaggagctaaaccccaaaatcttggcccttcagaacgcccagcgtaaacgaaaaatggaacatgacggtagcctcttccaggcagtggggatcggcactctgcttcagcagcccgatgaccatgccgccaccacttccctgtcttggaagcgggtaaaaggctgcaaatcttctgaacaaaatggcatggagcagaagacaatcatactcatccccagtgacctagcctgtcgtctgttaggccaatctatggacgagtcaggccttccccagctgacatcttatgactgcgaagtgaatgccccaattcagggctcaaggaatcttctgcagggcgaggagcttttacgagcgctagaccaggtgaac

SEQ ID NO: 33064 - DNA, 2478 bp, Artificial Sequence
  Description of Artificial Sequence: Synthetic coding sequence
atggagggagcgggtggagccaatgacaaaaagaagatttcgtcagagaggagaaaggaaaagtcgcgggacgccgcccgcagcaggcggtcaaaggaatcggaagtgttctacgaactggcgcaccaactcccgctgccgcacaacgtctcatcccacttggacaaggcctctgtgatgcgactcactatatcctacctccgggtgagaaagctcctggacgcaggagatctcgacatcgaagatgatatgaaggcccagatgaattgcttctacctgaaagccctggacggattcgttatggtcctgaccgatgatggcgatatgatctacatctcagacaacgtgaataagtacatgggactcacgcagttcgagctgaccggacattcggttttcgacttcactcacccttgtgatcacgaagaaatgcgagaaatgctgactcatcgaaacggcctggtgaagaagggtaaggagcaaaatactcaacgcagcttcttcctgagaatgaagtgtactctgacctctcgcggacggaccatgaacatcaaaagcgcaacctggaaggtcctccactgcactggacatatccatgtgtacgacacgaattccaatcaaccccaatgtggctacaaaaagccaccaatgacgtgcctcgtcctgatctgcgaaccgatcccacatccatcgaatatcgagattccactcgattcgaaaaccttcctgagcagacattcgctcgatatgaagttcagctattgcgatgagcgcatcaccgaactgatgggatacgagccggaggagctgcttggccggagcatttacgaatactaccacgccctggattcggaccatctcaccaaaacccaccacgacatgtttaccaagggacaagtgactaccggacagtaccgcatgcttgctaaaagaggaggatacgtgtgggttgagactcaggcaaccgtcatctacaacactaaaaactcccaaccacaatgcatcgtgtgcgtgaactacgtcgtttccggcatcattcaacacgatctgatcttttcgcttcaacagactgaatgtgtgctgaaaccggtggagtcatcggacatgaaaatgacccaactcttcactaaggtggaatcggaagatacctcatccctcttcgacaagctgaagaaagaacctgatgccctgacccttctggccccggcggccggagacactatcatctcgctggactttggaagtaacgacactgagactgacgaccaacagctcgaagaagtgccgctgtacaacgacgtcatgctcccgtccccgaacgaaaaactgcagaatatcaatctcgcgatgtcaccactgcccaccgccgaaaccccaaagcccctccgctccagcgccgacccggcacttaaccaggaagtcgctctcaagctcgaaccgaacccggaatcgttggaactcagcttcaccatgcctcagattcaagaccagaccccatcaccgtcggacggttccacccggcagtcgtcaccagagccgaactcgccgtcagaatactgcttctacgtggactcggacatggtgaatgaattcaagctggaactggtcgagaagctcttcgcggaggacactgaggccaaaaacccgttctcgacgcaggacaccgatctcgacctcgaaatgttggctccatacatcccgatggacgatgacttccagcttaggtcattcgaccaactttcgcctcttgagtcgtccagcgccagccccgagtcagctagcccacagtcgaccgtgaccgtgtttcagcaaacccaaattcaagagccgactgctaatgccaccaccaccactgctactaccgacgaattgaaaactgtgactaaagatcggatggaggacattaagatcttgatcgcatccccgagcccgacccacatccacaaagaaaccacctccgccacttcctcgccgtaccgggacacccagagcagaaccgcctcaccgaaccgcgccggcaaaggcgtgatcgagcaaactgaaaagtcccacccacggtccccgaacgtgttgtcggtcgcgttgtcgcagcgcactaccgtgccggaagaagagctcaacccaaagattcttgcgcttcagaacgctcaacggaaaaggaaaatggagcacgacgggtccctgttccaagccgtcgggatcggaaccttgcttcaacagccggatgatcatgctgccaccacttccctgtcatggaagagagtcaaaggctgcaagtcctcggagcagaatggaatggagcagaaaaccatcatcctcattccatctgacctggcgtgccgcctgttgggacagagcatggatgagtcgggacttcctcaactgacttcatacgattgcgaggtgaacgcgccgatccagggctcgcggaacctgctccaaggcgaagaattgctgcgagccttggaccaggtcaac

SEQ ID NO: 33065 - DNA, 2478 bp, Artificial Sequence
  Description of Artificial Sequence: Synthetic coding sequence
atggaaggagcgggtggtgcaaacgataagaagaagatttcttcggaaagaaggaaggagaaatcccgagatgcagcacggtcaagaagatcaaaggagtcagaggtgttttatgaacttgcacatcagttgccgctgccccataacgtctcttcccatctggataaggcatcggtgatgagacttactatttcctacctgagggtgcgaaagctgttggatgccggagatctggatatagaagatgatatgaaggcccagatgaactgcttttacctcaaggccctggacggcttcgtgatggtgcttacggacgacggtgatatgatctacatcagcgataatgtgaacaaatacatgggcctgactcagtttgaactgaccggacacagcgtgtttgatttcacccatccatgtgatcatgaagaaatgagagagatgcttactcaccgcaacgggcttgtgaaaaagggaaaggaacagaacacccagcgcagcttcttccttagaatgaagtgtacccttacttcccgaggaaggacgatgaacatcaaatcggctacctggaaggtgctgcattgtacgggccatatccacgtgtacgacaccaattccaatcaacctcaatgtggctacaagaagcctcccatgacttgcctcgtgctgatttgtgagcccattccacaccctagtaacatcgagattccacttgattctaaaacgtttctgtcgagacactcgcttgatatgaagttctcatactgtgacgagcgcatcaccgaactgatgggttacgaacctgaggaattgctcggacgtagcatatatgagtactaccatgcacttgattcagatcatctcaccaagacccatcacgatatgtttaccaagggtcaggtgacgacgggacagtaccgaatgcttgcgaagcgagggggctacgtctgggtcgaaacccaagcaaccgtcatctacaacaccaagaattctcagcctcagtgcatcgtctgtgtgaattacgtggtgagcggcatcattcagcatgatctcatattcagtctccaacaaaccgaatgtgtcctgaaaccagtggaaagctccgacatgaagatgacccaactttttaccaaggtggaatctgaggacacctcgtccctttttgacaaacttaagaaggaaccggacgcgcttactctgctcgccccagcagctggagacaccatcattagcctggattttggatccaacgatacggaaacggacgatcagcaactggaagaggtgccactgtacaacgatgtgatgcttccttcacccaacgagaaacttcagaacatcaatcttgcaatgtcgccactcccgaccgcagaaaccccaaagccacttcggtcctcagcagatcccgcattgaatcaagaagtcgcactcaaactggaacctaatccagaatcgttggagctgtcattcaccatgccacaaattcaagatcagactccttccccaagtgacggtagcacccgccaatcgtcgcctgagcctaactcgccgagcgaatactgcttttacgtggactccgacatggttaacgaattcaagctcgaacttgtggaaaagctctttgccgaggacaccgaggcgaaaaatccattctcaactcaagatactgacctcgatcttgaaatgttggcaccttacattcctatggatgatgactttcaactccggtcatttgatcagctgtcgcccttggagtcctccagcgcatcgcctgagagcgcgtcaccacagtcgacggttacggtgttccagcaaactcaaatccaagagcctaccgccaatgccaccactactactgccacgactgatgaactgaaaaccgtgacgaaagacagaatggaagatatcaaaattcttattgcttcccctagtccaacccacatccataaggaaaccacttccgcaacttcctcaccataccgtgatacgcagagccggactgcctctccaaacagggctgggaaaggcgtcattgagcagaccgaaaagagccatcctaggtcgcccaacgtcctctccgtggcactgtcccagagaactactgtcccagaagaggagcttaaccccaagatcctcgctcttcagaatgcacaacgcaaacgcaagatggagcacgacggaagcctgtttcaggccgtcggtattgggactctcctccaacaaccagatgatcacgccgcaaccactagcctttcctggaagagagtgaaggggtgcaagtcctcggaacaaaacggaatggaacaaaaaacgataattctgatccctagtgatttggcgtgccgactgttgggtcaatcgatggatgagagcggcctcccacagctgacttcgtacgattgtgaagtgaatgcacctatccaaggatccaggaacctccttcaaggagaagaattgctgcgggcgcttgaccaggtcaac

SEQ ID NO: 33066 - DNA, 2478 bp, Artificial Sequence
  Description of Artificial Sequence: Synthetic coding sequence
atggagggtgcgggtggcgcaaacgacaagaaaaagatcagttcagaaaggcgcaaggaaaagtctcgcgacgccgccagatccagacgaagtaaggaatccgaggtgttctatgagttagcccaccagttgccactcccccacaacgtgtcgagccatcttgacaaggcgagtgtcatgcgccttactataagttacctgcgcgttaggaagctccttgatgctggagatctcgatatcgaggacgacatgaaggcccagatgaactgtttttaccttaaggcattggacgggttcgtgatggtgcttaccgacgacggggatatgatttacatcagcgacaacgtgaacaagtatatgggcctaacccagttcgagttaaccgggcattcggtgttcgactttacacacccctgcgaccacgaagaaatgcgagagatgctgactcacagaaacggcctggtcaagaagggtaaagaacaaaacacccaaaggtccttcttcttgcgaatgaagtgcactctgacctcgaggggtcgcaccatgaatataaaatccgccacatggaaagtcctccattgcactggccacattcatgtgtacgacaccaatagcaatcagccacagtgcggctacaagaaacctcccatgacatgcttggtattgatttgcgagcccatcccgcatccctcaaacattgagatacccttagacagtaagacattcctgtccaggcacagcctcgacatgaagttttcctactgtgacgaacggatcactgagctgatgggctacgaacccgaggagctccttggcaggagtatttacgaatattatcatgcactggacagcgaccatctgaccaagactcatcatgacatgttcacaaagggtcaggtcacaaccgggcagtatagaatgttggctaaaaggggggggtacgtgtgggttgagactcaagcgaccgtgatatataatacaaaaaactcccagccccaatgcatagtgtgcgtgaattatgtcgtctccgggatcatacagcatgatcttatcttcagcctccagcaaaccgagtgcgtcctgaagccagtggagtcatccgacatgaaaatgacccagctttttaccaaggtggagtctgaagatacgtcttcgctgttcgacaagttgaagaaagagcccgatgcactcacactccttgcccctgcagctggcgacaccatcatcagcctggatttcgggagtaatgatactgagaccgacgaccagcagctcgaggaggtacctttgtacaacgatgtcatgctgccttctcccaatgaaaaactgcagaacataaatctggccatgagccctcttcctacagctgagaccccgaaacccctcaggtcttctgcggatccagccctgaatcaggaggtggctctgaagcttgagcccaatcccgagagcctcgaactatccttcactatgccacagatccaggatcagacgccctccccatctgacggtagcacccgacaatctagccccgaaccaaattcgccttctgaatattgcttctatgtggattccgacatggtgaacgagttcaaactggagctggtcgagaaattattcgcggaggacaccgaggctaaaaacccattctccacccaggacactgacctcgacttggaaatgctggcgccgtatatcccgatggacgatgatttccagctgaggtccttcgatcagctgtcgcccttagagagctcctcggcgagccccgagtccgctagccctcaatcaacagttacagtattccagcagacccagatccaggagccaaccgctaatgctaccaccactactgccaccaccgatgagttgaagaccgtgactaaagaccggatggaagacattaaaatcctaatcgccagcccaagccccacgcatatccacaaggagactacaagcgccactagctcaccttaccgcgatacccagagccgcaccgcgtcccctaatcgggccggaaagggggtgattgaacaaaccgaaaagagtcatccgcgcagccctaacgtcctaagcgtggctctctcacagcgcacgaccgtcccagaggaggagctgaatcccaaaattttggcccttcagaatgcgcagagaaagcgcaagatggaacatgacggctctctgttccaggcggtgggcattggcacgcttctccagcagccagacgaccacgccgcgactacttctcttagctggaagagagtgaagggctgtaaatcgtcggaacaaaatgggatggagcaaaagacaatcatccttattcccagtgatttggcttgtcgtttgctaggacagagcatggacgaatccggcctgcctcagcttacatcgtacgactgcgaagtgaacgctccaatccaagggagccgaaacctcctgcaaggtgaggaacttctgcgcgcactcgaccaggtgaac

SEQ ID NO: 33067 - DNA, 2478 bp, Artificial Sequence
  Description of Artificial Sequence: Synthetic coding sequence
atggagggtgctggaggagcaaacgacaaaaaaaagatcagtagcgaacgccggaaggaaaaatcacgcgacgcagcgcgctcgagacgatccaaagagtctgaggtgttttacgagctggcccatcagctccccctgccacataacgtctcgtcccacctggacaaagcgtctgtcatgaggcttactatctcttacctcagagtgcgaaaattgctggacgctggcgatctggacatcgaggacgatatgaaagcacagatgaactgcttttacctgaaagccctcgatggtttcgtcatggtgctgacagatgacggtgacatgatttatatcagtgacaatgtcaataaatacatgggcctgacacagttcgagctgaccgggcactcagtgttcgacttcacacatccgtgtgatcacgaggaaatgcgggaaatgcttacacatcggaatggactcgtcaagaaaggcaaagagcagaatacgcaacgcagcttcttcctgaggatgaagtgcacactcacaagccgcgggagaactatgaacatcaaatctgctacgtggaaagttctgcattgcaccggtcacattcacgtgtatgatacaaactccaatcaacctcagtgtgggtacaagaagccccccatgacctgtcttgtgctgatttgtgaaccgattccgcacccttctaacatcgaaatacccctggactcaaagacatttctctcacgacactctttggacatgaagttttcctattgcgatgagcgaataacagaactgatgggctacgagccagaggagctgctgggcaggtcaatctatgagtactatcatgcccttgacagcgatcacctcaccaagactcaccacgacatgttcactaagggccaggtgaccactggtcagtatcggatgctcgctaaacgagggggatatgtgtgggtcgagacacaggctacagtgatttacaatacaaagaactctcaacctcaatgcattgtatgcgtgaactatgtggtatcagggatcattcaacacgacctgatcttttctctgcaacaaaccgagtgcgttctcaagccagtggaatcaagcgatatgaagatgacccagctgttcacgaaagttgaaagtgaagatacttcttcgctgttcgataaactgaaaaaggagcctgacgctctgactctattggcacctgcagcaggagacaccattattagtctggatttcggcagcaacgacactgaaactgacgatcagcagctcgaagaggttccactctacaacgacgtaatgctgcccagccctaacgaaaagcttcagaatataaatcttgcaatgagcccacttcctactgcggaaacacctaagccccttcggtcgagcgccgaccctgcactcaaccaggaggtagcactgaagctcgagcctaaccctgaaagcctggagttgtcctttacaatgccacagatacaggatcagacacccagccctagtgatggctctactaggcagtcctcccctgaacccaacagtccctccgagtattgcttctacgtagactccgacatggttaacgagttcaagttggagctagtagaaaaattgttcgcagaggatactgaggccaaaaatccatttagcacccaggatacagacctagacctagagatgctggccccttacataccaatggacgacgattttcagttgagatcattcgatcagctgagccctctggagagctcctccgcctcgcccgaatctgctagcccccaatccactgttactgtatttcaacagacgcagattcaagagccaacagccaacgctacgaccactacagcaacgacagatgaactaaagaccgttactaaggaccggatggaggatatcaagatactgatcgcctctccatctccgactcatatccacaaagaaacaacttccgccaccagctctccttatagagacacacagtctcgaacagcatcccctaaccgggccggcaagggcgtaatagaacagactgagaagtcccaccccagaagtcccaacgtgctaagtgtggctctgagtcagaggaccaccgttcctgaagaggagttgaatccaaagattcttgcccttcagaacgcacaaaggaagcgaaagatggagcatgacggttctctgttccaggctgtgggaatagggaccctgctccaacaaccagacgaccatgccgcgactacttccctcagttggaaaagagtcaagggctgcaaatcgagtgagcagaacggcatggagcagaagacaatcatcctcattccttctgatcttgcctgccgactgctgggacagtcgatggacgagagtgggctgccacagctaacatcttatgactgtgaagtgaacgctcccatccagggatccagaaacctcctgcagggcgaggagctccttcgggctctggatcaggtgaac

SEQ ID NO: 33068 - DNA, 2478 bp, Artificial Sequence
  Description of Artificial Sequence: Synthetic coding sequence
atggagggggctggaggcgctaacgacaagaaaaaaataagctcagagcgtaggaaagagaaaagcagagatgctgcgagaagccggagaagcaaggagtccgaggtgttctacgagctggcacatcaactgcctctgccgcataacgtgagctcccatctggataaggcatctgtgatgagactaacaatctcatatctcagggtgcggaagctccttgacgccggagatcttgatattgaggatgatatgaaagctcagatgaactgtttctacctaaaagctctcgatggatttgtcatggtgctgacagatgatggagacatgatttatatcagcgataacgtgaacaaatacatgggtctgactcaattcgagctgaccggccatagcgtgttcgacttcacacatccctgcgatcacgaagaaatgagggagatgcttacccaccgcaacggattggtgaaaaaaggcaaagagcagaacacccagaggagcttcttccttcgaatgaaatgtacactgaccagcaggggccggactatgaacattaagtctgctacgtggaaagtgctgcattgcacagggcacattcacgtgtatgacacaaactcaaaccagcctcaatgtggatacaagaagcctcctatgacatgccttgtcctgatctgcgagcccatacctcacccatctaatattgaaatccctctggacagcaaaaccttcttgtcgcgccattccttagacatgaaattttcatactgtgatgaacggatcacagagctgatggggtatgagccagaggagttgctggggcgcagcatttacgaatactaccacgctctggacagcgatcacctgactaagacacaccacgatatgttcaccaagggccaggttaccactggtcaataccgcatgctggctaaacgtggtggctacgtgtgggtcgaaacacaggccactgtgatttacaacaccaagaacagtcaaccacaatgcattgtctgtgtaaactatgtggtcagcgggatcatacaacacgatctgatcttttcacttcagcagaccgaatgcgtactgaaacccgtcgagtccagtgacatgaagatgactcagctattcacaaaggtggaaagtgaagacaccagctctctgttcgataaacttaagaaggaaccagacgctctgacactcctggcacctgcagctggagacacaattatcagtcttgacttcggatctaacgacactgagacagatgatcaacagctggaggaggtcccactctacaacgatgtcatgctgcccagccctaacgaaaaattgcagaacattaacctggccatgtctccactgccaaccgccgaaacccccaaacccctcagaagcagcgcagatcccgccttaaaccaagaagtggctcttaaacttgaaccaaacccagagagcctggagctgtcttttacaatgcctcagattcaggatcagacccctagccccagcgatggaagtacccgccaatcctcccccgagccaaacagcccctcggagtactgtttctacgtcgactccgatatggtaaatgaatttaagctggagctggtggagaagttgtttgcagaagacacagaagccaaaaacccattttcaacccaagacactgacctcgatctggaaatgctcgctccctacatcccaatggacgatgatttccaactgaggagtttcgatcagcttagcccactggagtcttcctctgctagcccagaaagtgcatccccgcagagcaccgtgacggtttttcagcaaacccaaatccaagagccaaccgcaaatgctacaactaccacagcaaccacagacgagctcaaaaccgtgactaaggacagaatggaagatatcaagatactgatcgctagcccatctcccactcatatccataaggagaccacatctgcgactagtagtccatacagggatacacaatcacgcaccgcaagtccaaaccgggctgggaaaggcgtgatcgaacaaactgagaagagtcacccaagaagcccaaatgtgttgtcagttgccctgagccaaaggactaccgtcccggaggaggaactgaatcccaagatactcgccctgcagaacgcacaaagaaagaggaaaatggaacacgacggctctctttttcaagcagtcgggatcggaactctgcttcagcagcctgacgaccatgcagctacaacttccctgtcatggaagagagtcaagggatgcaagtctagtgaacagaacgggatggagcaaaaaacaatcatcctgatccctagtgatcttgcttgcaggctgttgggacagtccatggacgagtcaggactgcctcagctcacttcctacgactgcgaagtcaacgctcccatacagggttctcgcaacctgctccagggggaagaactccttagggcacttgaccaggtgaac

SEQ ID NO: 33069 - DNA, 2478 bp, Artificial Sequence
  Description of Artificial Sequence: Synthetic coding sequence
atggaaggtgcggggggtgccaacgacaagaagaagatcagttcagagcgccggaaagagaagtcacgcgacgcagcgaggagccgaagatccaaagagtcggaggttttctacgaactcgcacaccagttgccattgccacacaacgtctcctcacatctcgataaggcttcagtgatgcgactgacgatctcatacttgagggtccggaagctcctggacgccggagatcttgatattgaggacgacatgaaagcgcagatgaattgcttttacctgaaagcattggacggattcgtgatggtgttgactgacgatggcgacatgatctacatctctgacaatgttaacaagtacatgggcctgacccagttcgagcttactggacactcggttttcgacttcactcatccgtgtgaccacgaagagatgcgcgaaatgctgacccatagaaacggactggtgaagaaaggcaaggaacaaaacactcagcgctcgtttttcctccggatgaaatgtaccctgacttcaagaggtcggaccatgaatatcaaatcagccacgtggaaggtccttcactgcacgggacacatccatgtctacgacactaactctaatcaaccacagtgcggctacaagaagcccccaatgacttgccttgtgctgatctgtgaaccaatcccgcacccgtcaaacatcgagattccacttgactcaaagacttttctctctcgtcattcactggacatgaagtttagctattgcgacgaaagaatcacggaactcatgggatacgaaccggaagaactcctgggccgctcgatctacgagtattaccacgccctcgattcggatcacctgaccaagacccatcatgacatgttcaccaaaggacaagtgaccactggacagtaccgtatgctcgcgaagcggggaggatacgtgtgggtcgaaactcaggccactgtcatatacaacacgaagaactcacaaccgcaatgcatcgtctgcgtgaactacgtggtgagcgggatcatccagcatgacctgatcttttcactccagcaaaccgaatgcgtgctgaagcctgtggaaagcagcgacatgaaaatgacgcaactcttcaccaaggtggagtcggaagatacctcatcattgttcgacaaactcaagaaggaaccggatgcattgactctgctggcgccggccgcaggggacactattatctcgttggatttcgggtccaacgacaccgagactgatgatcaacagctggaggaggtgccgctgtacaacgacgtgatgttgccctcaccgaatgaaaagctgcaaaacatcaatttggcaatgtcaccgctccctactgcggaaaccccgaagcccctgagatctagcgccgacccagccctgaatcaagaagtggctctcaaacttgaaccaaatccggagagtctcgagctcagctttaccatgccgcaaatccaggaccagactccgtctccttcagatggaagtactcgccaatcaagccccgagcctaactcgccgtctgaatactgcttttacgtcgactccgatatggtgaacgaattcaagctcgaacttgtcgaaaaacttttcgcggaggataccgaagccaaaaaccctttctcgacgcaagacactgatctggatctggagatgctggcgccctacatcccaatggatgacgatttccagctgagatcgttcgatcagctgtcacctctggaatcgtcctcggcttctccggaatccgcctccccccagagcaccgttaccgtgttccagcagacccagatccaggagccgaccgccaatgccaccactaccaccgccactactgacgaacttaagaccgtgaccaaagatcgcatggaagatatcaagattctgatcgcaagtcccagcccgacccacattcataaggaaactaccagcgcaacctcctcgccttatagggacactcaatcgaggaccgcctcgccaaaccgggctggaaagggcgtcatagagcagacggagaaatcgcacccacgatcgccgaacgtgctttcggtggcactgagccagcggactacggtacctgaagaggagctcaacccgaagattctggccctgcaaaatgctcagcgcaaacggaagatggagcacgacggctccctttttcaggccgtggggatcggtacgttgttgcagcagccagatgaccacgccgctaccactagcctgtcctggaagcgcgtcaaggggtgcaagtcgtcggaacaaaatggaatggaacaaaagaccatcatcttgatcccgtccgatctcgcgtgtcggctgctgggccagagtatggacgagtcaggactgcctcagcttactagctacgactgtgaggtcaacgcaccaattcagggatcacgcaacctgctgcaaggagaggagctccttcgggctctggaccaggtgaat

SEQ ID NO: 33070 - DNA, 2478 bp, Artificial Sequence
  Description of Artificial Sequence: Synthetic coding sequence
atggaaggcgcgggaggagccaacgacaagaagaagatctcctcggaaagacggaaggagaagtcaagagacgcagccaggtcacgacgatcgaaggagtcagaagtgttctacgagcttgcccaccagctccccctcccgcacaatgtgtcctcccatcttgataaagcgagcgtgatgcggctgactatctcatacctgcgagtccgcaaactgctcgacgccggggatttggacatcgaagatgatatgaaggcccagatgaattgcttctacctgaaggccttggacggttttgtgatggtcttgaccgacgacggggacatgatctacattagcgacaacgtgaacaagtacatggggctgacccagtttgaattgaccggacacagcgtgttcgacttcacgcacccttgtgaccacgaggaaatgagagagatgctgacgcatcgtaacggcctcgtgaagaaggggaaggagcaaaatactcagagatccttcttcctccgcatgaagtgcaccctgacttcacggggtcgaaccatgaatatcaaatcggccacttggaaggtcctccactgcactggacacatccacgtgtacgacaccaacagcaaccaaccgcagtgcggatacaagaagccgccgatgacgtgtctcgtgctgatctgcgaacctattccacacccctcgaacattgagatccctctcgattctaaaaccttcctgtcgaggcactcgcttgatatgaaattctcctactgtgatgaacgaatcactgagcttatgggatacgagcccgaggaactcttgggcaggagcatctacgaatactaccacgctctggattcagatcacctgaccaagacccatcacgatatgttcaccaagggtcaggtcacgactgggcagtatagaatgctggctaagcggggcggctacgtctgggtggaaactcaggcgactgtgatctacaataccaaaaacagtcagccgcagtgtatcgtgtgcgtgaactatgtggtgagcggaatcatccagcacgatctgatcttctcactgcaacaaaccgaatgcgtccttaagccggtggaatcgtccgacatgaaaatgactcaactgttcacgaaggtggaatcggaggacactagctcccttttcgacaagctcaagaaggagccggacgccctgaccctgctcgccccagcggcaggggacactatcatttccctggacttcggttcgaatgatactgaaaccgatgaccagcagctggaagaagtcccgctctataacgacgtgatgctcccttcgccaaacgagaaactccagaacattaatctggccatgtctccactgcctaccgcagagactccaaagccgctgaggtcgagcgcagatcctgccctgaatcaagaggtcgctctgaagctggaaccgaacccggagtcgctggagctctcattcactatgccacagatccaggaccagactccgtccccttccgacggttcgactcgccagtcgtccccggaaccaaattcaccgagcgagtattgcttttacgtggactcagatatggtcaacgagtttaaactggaactggtcgagaagctcttcgcagaggacaccgaagcgaagaacccgttcagcactcaggacactgacctggacctggaaatgctcgctccctacattcctatggatgacgacttccagttgagatcattcgatcagctgtcccctttggaatcttcatcggccagccccgaatcagcttcgcctcaaagcactgttaccgtgttccagcagactcaaatccaggagccaaccgcaaatgccacgaccaccactgcgacgactgacgagctcaagactgtgactaaagaccggatggaggacatcaagatcctgatcgcatcaccctccccgacccacatccacaaggaaaccacttcagccacttcatccccataccgcgacacccagagccggaccgcttcgcccaatcgcgctggtaagggcgtcatcgagcaaaccgagaaaagccatccacggagcccaaacgtactgtcagtggccctgtcccaacgcacgactgtgccggaggaggaactcaacccgaagatcctggcccttcaaaatgcccagcggaaaagaaaaatggagcatgatggatcccttttccaggccgtgggcatcggaaccctcctgcagcagccggacgatcacgctgcaactacttctctgtcctggaagcgggtgaaaggttgtaagtcgagcgagcagaatgggatggagcaaaagacgatcattctcattccgtcggatctggcctgtcggctgctcggtcaatcgatggacgaatcgggactgccgcaactgacctcctatgattgcgaagtcaacgcccctatccagggaagcaggaacctgctccaaggagaggagctcctgagagccctcgaccaggtgaat

SEQ ID NO: 33071 - DNA, 2478 bp, Artificial Sequence
  Description of Artificial Sequence: Synthetic coding sequence
atggagggcgctggaggggccaacgacaagaagaaaatcagcagtgaaagaagaaaggaaaagagtcgagacgctgcccgctcacggagatctaaggaaagcgaagtcttctacgaactcgcccatcaacttccgctgccacacaacgtaagctctcatctggataaggccagtgtgatgcgactcacaatctcatacctgagagtgcggaagttgctggatgccggcgacctggacattgaggatgatatgaaggcacagatgaactgtttctatttgaaggcgctcgacgggtttgtaatggtcctgactgatgatggcgacatgatttacatttcagacaatgtgaacaaatatatggggctgactcaatttgagcttaccggacattccgtatttgacttcacacatccatgcgatcacgaagaaatgagagagatgcttacccataggaatgggcttgtaaagaaaggtaaggagcaaaacacgcagagatcattctttctgcgaatgaagtgcaccctgacgtcccgcggtcgcaccatgaatattaaaagcgcaacttggaaggtgctgcattgcacggggcacattcacgtctatgatactaactccaaccagccacagtgtggatacaagaagcccccaatgacctgcttggtcctgatctgtgagcctataccccacccgagcaacatcgaaatacccctggactccaagacctttctgagcaggcactcacttgatatgaagttttcctactgtgatgaaagaattaccgaactcatgggatatgagcccgaggagttgctcgggcggagcatttacgagtactatcatgcgttggacagcgatcatctgaccaaaactcatcatgatatgttcaccaaagggcaagtgacgaccggtcagtatcggatgctggccaaacggggcggatatgtatgggttgagacccaggccacagtgatctacaacacaaaaaattcccagccacagtgcatcgtatgcgttaattacgtggtgagtggcataatccaacacgacctgattttctctcttcagcagaccgaatgcgtgctgaagcccgtcgaaagttctgatatgaaaatgacacagctgtttactaaggtggaatccgaggatacatcaagtttgtttgacaagctgaagaaagaacccgacgcactgaccctcctcgctccagccgctggcgacacaataattagtttggatttcggcagcaacgatactgaaaccgacgaccagcagctggaggaggtgcccctctataacgatgtgatgctgcccagtcccaacgaaaaacttcagaatatcaatttggcaatgtcacctctcccaaccgccgagacacccaagccactgcgatcatctgctgaccctgcgctgaatcaagaggtggccctgaaactggaaccaaacccagaaagcctggaattgtcctttaccatgccccagatccaggatcagaccccctctccttctgacggttccacccgacagtctagcccggagccgaacagcccaagcgaatactgtttctatgtggattctgatatggtaaatgagtttaagctggagctcgtcgaaaaactgttcgccgaggacaccgaggccaagaacccgttctctacgcaggatacagatctggacctcgagatgttggcaccctatatccctatggacgatgatttccaactgcggagcttcgatcagctgtcccccctcgaaagctcctctgcgtctcccgagtcagcatctccacagagcaccgttaccgtatttcagcaaacccaaatacaagagcccactgctaatgctacaactacgaccgccaccactgatgagctgaaaaccgtaaccaaggacaggatggaggatatcaagattctcatcgcctctccctcacctacacacatccataaggagactacatctgctacctcttctccttacagggatactcagtctaggacagctagtccgaacagggccggcaagggcgtgatcgagcaaacagagaaaagtcaccctagatctcccaatgtgctgagcgtggccctgtcccagcggaccaccgtcccagaggaggaattgaatcctaaaatactggccctgcagaatgcccagcgaaaaaggaaaatggaacacgacggttctctgttccaagccgtggggatcggcactttgctccagcagcctgatgaccacgctgcaacaactagcctgagttggaagagggtcaaagggtgcaaatcatctgaacagaatggaatggagcaaaagacaataatccttataccaagtgatttggcctgcaggttgctggggcagtctatggacgagtccggcctgccccaactgacgtcttatgattgtgaggtcaatgccccaatccagggctcacggaatctcctccagggggaggaactgctcagagctctggaccaggtaaac

SEQ ID NO: 33072 - DNA, 2478 bp, Artificial Sequence
  Description of Artificial Sequence: Synthetic coding sequence
atggagggcgctgggggggctaacgacaagaagaagataagcagcgagcggaggaaagaaaaaagcagagacgctgcacggtcccgtcgaagtaaggagtcagaggtcttttatgagctcgcccatcagctgccactcccccacaacgtctcgtctcacctagataaagcctctgtcatgaggctgaccatctcatacttacgagtgaggaaactattagacgccggggacctggatatcgaggatgatatgaaagctcagatgaattgtttttacctcaaagcgttggatggcttcgtcatggtactgacagatgacggcgatatgatctatatctcagacaatgttaacaagtatatgggtctgacccagttcgagcttacgggacatagcgtctttgattttacacatccttgtgatcacgaagagatgcgtgaaatgctgacccaccgcaacggtctagtgaaaaagggaaaagagcagaatacacaacggtctttttttctgcgcatgaagtgcactctgacctccaggggacgcaccatgaatatcaaatctgccacatggaaggtgctacactgtaccggccatatccacgtgtacgacacaaactcaaaccagccacaatgcgggtataaaaagcctcccatgacatgccttgttctgatctgtgagccgataccacacccgagtaacatcgagatccctctcgactccaaaacgtttctcagcaggcactcgctcgacatgaaattttcctattgtgacgagaggattacagagcttatgggctacgagccagaggaattgctcggccgcagcatctacgaatactatcacgcactcgatagcgaccacctcactaagacccaccacgacatgtttacaaaggggcaagtgaccaccggccaatatcgcatgctcgccaagaggggagggtacgtctgggttgagacgcaggccaccgtgatatacaataccaagaactctcagccacaatgcatcgtatgtgttaattatgtggtcagtggaattattcagcacgacttaatcttttctctgcagcaaaccgaatgcgttttgaaacctgtggagagttctgacatgaagatgacacaactcttcactaaggtggaatctgaggatacctccagtcttttcgacaaactgaagaaggagccagatgctttaactctgctggcccccgccgccggcgataccattatctccctagacttcggtagcaatgatacagagaccgacgatcagcagctggaggaagtgcccctgtataacgatgttatgctcccctcgccaaacgaaaagctgcagaacattaatctagcaatgtcaccattgcctacggcagagacccctaagcctctgcgaagctccgccgatcccgccctgaatcaagaagtggctctgaaactggaaccgaaccccgagtccctcgagctgtcttttaccatgccacagattcaggatcagacaccttcccctagcgatggtagcacaaggcaatccagccctgaacctaactcacccagcgaatactgtttttatgtggactccgatatggtgaatgagttcaaactcgaactggtcgagaagcttttcgccgaagatactgaggcaaagaatcccttttctacacaggatacagatctcgacttggaaatgctggctccctatatacctatggacgacgacttccagttgagaagctttgaccagctatcgccactcgaatctagtagcgcgtctcctgagtcggcgtcccctcaatcgaccgttaccgtgttccagcagacccaaatccaagaaccaaccgcgaatgccactaccacaaccgctaccactgacgaactgaaaaccgtaactaaggaccggatggaagacataaaaatcctgattgcctccccctccccgacacatatccataaagaaacgacctcagccacttcatcaccataccgcgatactcaatcgcgaaccgcctcacctaatcgagccggaaaaggagtgatcgaacaaaccgagaagtcccatccaaggtcccctaacgtgttgagcgtcgcactgagccagagaacaaccgtgcccgaagaggaactgaaccctaaaattctggccctccagaatgcccagcgaaagcggaagatggagcacgatggcagccttttccaagcagtggggatagggactcttctgcaacagcctgatgatcacgcggctacaacatccctttcgtggaaacgggttaaggggtgcaagtcttctgagcaaaatggcatggaacagaagactatcattctgattcccagtgatctggcatgcaggctcctaggccagtcgatggatgagtcagggctacctcagctgaccagttatgactgtgaggtcaacgcccccatacagggctccaggaatctcctccaaggcgaggaactcttgagggccctggaccaagtaaat

SEQ ID NO: 33073 - DNA, 2478 bp, Artificial Sequence
  Description of Artificial Sequence: Synthetic coding sequence
atggagggggctggaggagcaaacgataagaagaagataagcagtgagcggcggaaggagaagagtagggacgccgcacgtagtaggagatccaaggaaagtgaagtgttttacgaactcgcccaccagctgcctctgccacacaacgtgtccagccaccttgacaaagcctctgtaatgagattgaccatcagttatctcagagttcggaaactgttggacgccggagaccttgatattgaagatgacatgaaggcacagatgaactgtttttatctgaaagccctagatggatttgtcatggtgctgactgatgatggcgatatgatttacatctccgataatgtgaacaagtacatggggcttacacagttcgagcttacaggacatagtgtgttcgactttactcatccctgcgatcacgaagaaatgagagaaatgctaactcatcgaaatgggttggtcaagaaaggtaaggagcagaacacccaacgctcttttttccttcgaatgaagtgtacccttacgtcacgggggaggactatgaacatcaagagtgccacgtggaaggtgctccactgcacgggtcacatacacgtgtacgacaccaactccaaccaacctcagtgcgggtataagaaaccgcccatgacttgtctcgtactcatatgtgagcccattccacacccctctaatattgagattccccttgacagcaagacttttctgagccggcactcactagacatgaaattttcatactgcgacgaacggatcactgaactgatggggtacgaacccgaagagctcctcggccggtcaatctacgaatattaccacgccctagatagtgaccatctcactaagacacaccacgatatgtttactaaagggcaggtcacgacagggcagtataggatgctggccaagcgtggcggttacgtctgggtagagacacaggctactgtcatttataacacaaaaaattcccagcctcaatgtatcgtctgcgttaattatgtggtgagcggaattatccagcacgacttgatttttagcctccagcagacagagtgcgtgctaaaaccagttgaaagttctgacatgaaaatgacacaactgtttactaaggtcgaatccgaagataccagtagcctgttcgataagctgaagaaagaacccgacgccctgaccctcctggctcctgccgcgggcgatacaattatttcactggactttgggagtaatgacactgaaacagacgaccagcagctcgaagaggtgccactgtataacgatgtaatgttgccctcccctaatgaaaaacttcaaaacatcaacctggcgatgagcccgctgccaaccgctgaaactcccaagcctctgagatcgtctgccgatccagcccttaatcaggaggtcgcattaaaactggaaccaaaccctgagagcctggaactaagctttacgatgcctcaaatccaagaccagacaccatcaccatctgatggatccacacgccagtctagtccagagcccaactcacctagcgaatattgtttttacgtagacagcgatatggtgaacgaatttaagctggagttagtggagaaactgtttgccgaagacactgaggccaagaatccattcagtacgcaggatactgacctagatctcgagatgctcgccccttatattcccatggacgacgacttccagctcaggtcattcgaccagctgtccccattggagtcctcctcagctagtcccgagtcagcaagccctcagtccacagttaccgtgttccaacagacacagattcaggagccaaccgccaacgcgacaactacaaccgcaaccaccgacgaactaaagactgtgaccaaggaccgcatggaagatatcaagatcctgatagcgagcccttcacctacgcatatccataaggagacaacgagcgctacatcctctccgtaccgagacacgcagtcgagaactgcttcacccaaccgcgctgggaagggcgttattgaacaaaccgaaaagtcccatccccgaagccccaatgttctgtccgttgcgctgagccagcggaccacagttcctgaggaagagctgaaccctaagatcctggcgctgcagaacgcccagcgcaagagaaagatggagcatgacgggtccctgttccaggctgtgggcattgggaccttgctccaacagcccgacgaccacgccgctacaacatcactgagctggaagagggtgaaggggtgcaagtcatccgagcagaacggaatggagcaaaagacgatcattctgatcccatctgacctcgcctgtcgcctactgggtcagtcaatggacgagagtggactgcctcaactgacgtcatatgactgtgaggtcaacgctccgatacaaggaagccgtaatttgctgcagggcgaggaactgcttagggcattagatcaggtgaac

SEQ ID NO: 33074 - DNA, 2478 bp, Artificial Sequence
  Description of Artificial Sequence: Synthetic coding sequence
atggagggagctggtggtgcaaatgataagaagaagatctcaagcgagcggcggaaggaaaagagcagagacgccgcacgctcacgccgctctaaggaatcagaagtcttttacgaactcgcgcaccaactccccctgccgcacaatgtgtcgtcacatctggataaagcatctgtgatgagactgaccatctcgtacctgcgagtgcggaagctgctggatgctggggatctggacattgaagatgacatgaaggcccagatgaattgcttttacctcaaagcgctggacggattcgtgatggtgctcactgacgacggcgacatgatttacatctcagacaatgtgaacaagtatatgggactcacccaattcgaactcactgggcattcagtctttgactttacgcacccttgtgatcacgaagagatgcgcgaaatgctcacccatcgcaatggcctcgtgaaaaagggtaaagaacaaaacacccagagatcgttctttctgcgcatgaaatgtactctgactagccgcgggcgcaccatgaacattaagtccgccacctggaaagttctgcactgcaccggacacattcatgtctacgacactaattcaaatcagccgcaatgcggatacaagaagccacccatgacctgcctcgtcctcatttgtgaacccattcctcatccgtcgaatatcgagatccctctggatagcaagaccttcctgtcccgccactccctggacatgaagttttcttactgtgacgagcggatcaccgaacttatgggatacgagcctgaggagctgctgggtaggagcatttacgagtactaccacgcgctggactcagaccaccttaccaaaacgcatcatgacatgtttacgaagggacaggtcactaccgggcagtaccgcatgctggcaaaacgaggaggatacgtgtgggtggaaacccaagcgactgtcatctacaataccaagaatagccaaccccagtgcatcgtgtgcgtgaactacgtggtttcaggaattatccaacacgatctgatcttcagcctgcagcaaaccgagtgcgtgctcaagccagtcgagagctcggacatgaagatgacccagctgttcaccaaggtggaatccgaggacacttcaagccttttcgacaagctgaagaaagagccagatgccctgactctgctcgcaccagccgcgggagataccattatctcattggatttcggctcgaatgacaccgagactgatgaccagcagttggaagaggtgccgctgtataacgatgtgatgctcccatcccccaatgagaaattgcagaatatcaacctggctatgtcacccctgccaaccgccgagactccaaagccgctccggtcgtcggcagacccggccctgaaccaagaagtggctctgaagctggaaccaaatcctgaatccctcgagctctcgttcaccatgccgcagatccaggaccagactccgtccccgtcggatgggtcaacccgccagtcatctccagagcccaactcgccgtcagaatactgtttctacgtcgactccgacatggttaatgaattcaagctggaactggttgagaagctgtttgcggaggatactgaagccaaaaaccctttcagcacgcaggatactgaccttgacctggaaatgctcgccccgtacatcccgatggacgacgatttccagctccggtcgttcgaccaactctcaccgctggagagctcctccgcaagtcctgagtcagcgtccccgcagtccaccgtgactgtgttccaacagactcaaatccaagagccaactgcaaacgctaccactaccaccgcgactactgacgaactcaagactgtgactaaagacagaatggaggacatcaagatcctgatcgcttcgcctagccctacgcacatccacaaagagactacctcagctacgtcgtccccctacagggacactcagagccggacggcttcgccgaaccgggcgggaaagggagtcattgaacaaactgaaaagtcacacccgcgctctcctaatgtgttgagcgtggcgttgagccagcgtaccaccgtgccggaggaggaactgaacccaaagatccttgccctccagaacgcacagcggaaacgcaagatggaacacgacggctcactgttccaagcagtcggaatcggaaccctcctccagcagcccgatgaccatgcggctactacctcgctctcgtggaagagagtcaagggttgcaaatcgtcggaacaaaacggaatggagcaaaagaccatcatcctgatcccctcggacctggcatgtcgcctgctcggtcagtcgatggacgaatcgggactgccccagcttacctcgtacgactgcgaggtgaatgcgccgatccagggatcacgcaatctgctccagggcgaggagcttctgagggccctggaccaagtcaac

SEQ ID NO: 33075 - DNA, 2478 bp, Artificial Sequence
  Description of Artificial Sequence: Synthetic coding sequence
atggaaggagcaggaggagctaacgataaaaagaaaatttccagcgaacgcagaaaggagaagtcccgggacgcggctagaagtcggcgcagtaaggagagtgaggttttttatgaactggctcaccaattgccgctgccacacaacgtctcctctcaccttgacaaggcatccgtgatgcggttaaccatctcctacctcagggtccgcaagcttctggacgctggtgatctagatatcgaggacgacatgaaggcccagatgaactgtttttatcttaaagcactggatggatttgttatggtgctgaccgacgacggagatatgatctacatttccgataatgtgaacaagtacatgggacttacacaattcgagcttactggccacagcgttttcgacttcacacatccgtgtgaccatgaagagatgcgagagatgctgacccatcgcaacggactcgtgaaaaaaggaaaagaacaaaatactcagagatcctttttcctcaggatgaaatgcacccttacaagccgaggcaggaccatgaatatcaagagcgccacttggaaggttctgcattgcactggtcacatccacgtgtatgatacgaatagtaaccagccacaatgtggatacaaaaaaccaccaatgacatgccttgtgctgatctgcgagccaataccccaccctagcaacatagagatcccacttgacagcaaaaccttcctttcacgccattccctggacatgaagttctcctattgcgatgagcgaatcactgagctgatgggatacgagcccgaggagctgttgggaaggtcaatctacgaatattaccatgccctcgactcggaccacctgaccaagacacaccacgatatgtttactaaaggtcaggtgactacagggcagtacaggatgctggcaaaacgcggcggatatgtctgggtggagacacaggcaaccgtgatctacaatacaaagaattcacagccacagtgtatcgtttgtgtaaactacgtcgtttcaggaataatccagcatgacctgatctttagcctccagcagacagagtgcgtactaaaacctgttgagagcagcgacatgaaaatgacacagctgttcacaaaggtggaatcagaagatactagcagtttgtttgacaaactgaaaaaggaacccgatgcgttgacccttttagccccagccgcaggagacactattatctcgcttgattttgggagcaatgataccgaaacggacgatcagcagctcgaggaagtaccgttgtacaacgatgtcatgcttccttcccccaacgaaaagctacagaacatcaacctcgcaatgagtccactgcccaccgctgaaacaccaaaacccctgagaagtagtgcagaccctgctctcaaccaagaagtggctctgaagttagaacccaaccccgaaagtctggaactgtctttcaccatgccacagatccaagatcagacacccagcccatcagacggcagcacgagacagagcagcccggaacccaacagcccatccgagtactgtttttatgttgacagcgatatggtcaacgaattcaagctggaactcgttgagaaattgttcgctgaagataccgaggctaaaaatcccttcagcactcaggatacggacttggacctagaaatgctggcaccctatatcccgatggatgatgacttccagctcagatcttttgaccagctgtcccccctggagtccagtagtgcctcgcctgagtcagcttcacctcagagtaccgtgaccgtgtttcagcagactcaaattcaagaacctaccgctaatgcgaccactactaccgccacgaccgacgaactgaagacagtgacaaaggaccggatggaggatatcaagatcctgatcgcaagcccatccccaacccatatccataaggagacaactagcgcgaccagctccccttatagagatacacagagtcgcacagcttctcctaatcgagcaggcaagggcgttatcgaacagacggaaaagagccacccaaggagtcctaatgtcctgagtgtggcactgtcccaacggactaccgtgccagaagaggaacttaaccccaaaattctggctttgcagaatgcgcagcgcaaacgtaagatggagcatgacggctcactgttccaggccgtgggcatcggaacccttcttcagcagcctgatgatcacgctgcaaccacttctctgtcatggaaaagggtcaagggatgtaaaagctcagaacaaaacggcatggaacagaaaaccatcatcctaatacccagcgatcttgcttgccgcctgctcggacaaagtatggatgagagcggactccctcaactcacctcttacgactgtgaggttaatgcaccaattcagggctccaggaacctgctgcaaggcgaggaattgttgagagcactggatcaagtgaat

SEQ ID NO: 33076 - DNA, 2478 bp, Artificial Sequence
  Description of Artificial Sequence: Synthetic coding sequence
atggagggggctgggggggcaaacgacaaaaaaaaaattagcagcgagcgacggaaggagaagtctcgggatgccgcgagatctcgccgctcaaaagaatcagaggtgttttacgagctggcccaccaactgcccctacctcacaacgtatcttcccacctggataaggcaagcgtcatgcggctgactatctcttacctgcgggtacgtaagctgctggatgcaggagacctggatatcgaggatgacatgaaggcccagatgaattgtttctacctgaaggccctcgatggatttgtcatggtcttaactgatgatggcgacatgatctacatctcagacaacgttaataaatacatgggtctcacacagtttgaactgactggccattctgtttttgacttcactcatccttgtgaccatgaagagatgcgtgaaatgctcactcatagaaatgggctagttaagaaaggaaaggagcagaacacgcagcggtcattcttcctgcggatgaaatgcacactgacaagccgcggccgaaccatgaatattaaatctgcgacctggaaagtgctgcactgcactggccacatccatgtgtacgacacaaacagcaaccagccacagtgcggttataaaaagcctcctatgacctgtctcgtcctgatttgcgagcctattccacaccccagcaacatagagattccattagattctaagacttttctttccaggcattcactggatatgaagttctcctactgtgatgaacggattactgaacttatgggttacgaacctgaggagttgcttgggagaagtatctatgagtattaccacgccctggactctgaccatctgactaagacacaccacgatatgttcactaaggggcaggttacaactgggcagtataggatgctcgcaaagcgcggggggtatgtctgggtagagactcaggctaccgtgatttataacacgaaaaactcgcagccacagtgtatcgtctgtgtgaattatgtggtttccggaatcatccagcacgatctaatattctccttgcagcaaaccgagtgtgttctgaagcccgtcgagagcagtgatatgaaaatgacccagttgttcaccaaagtggagtcagaagatacctcttcattgttcgacaaactgaaaaaagagccagatgccctgactttactagctccagccgccggcgacactatcatatccctcgattttggatccaatgacacggaaaccgatgatcagcagctcgaagaagtaccactctacaatgatgtgatgttgccctccccaaacgaaaagctgcagaatatcaatcttgccatgagccccctgcctactgccgaaacgcccaagcctctgcgctcaagcgcagatcccgccctgaaccaggaagtggctctgaagcttgaacctaatcccgaaagcctggaactaagcttcaccatgcctcagatacaagaccagacacctagcccctctgatgggagcacccgacagtctagcccagagcccaacagtcctagcgaatactgcttctatgtggatagcgatatggtaaacgagtttaagttagagcttgtggagaaactgttcgcagaggataccgaagctaagaacccatttagcacacaggacaccgatttagatctggagatgctcgccccatacattcctatggacgacgatttccagttgaggtctttcgaccagctatcgccactcgaatcttcgagcgccagccccgagtccgctagccctcagtctacagtaactgtcttccagcagactcagatccaggagccaaccgccaacgccactactaccactgccacaactgacgaattgaagaccgttacaaaggatcgtatggaggatatcaaaatattgatcgctagtcccagccccacccacatacataaggagaccacctccgcaacctctagcccataccgggacacacagtcgaggacagcgagccccaaccgggccggcaagggcgtaattgagcagacagaaaaaagccacccccgctcgcccaatgtgttgtctgtggccctaagtcagaggaccacggtgcccgaggaagaactcaacccgaagattctggccttgcaaaatgctcagcgtaagaggaagatggaacatgatggctctctgttccaggctgtcggaatagggaccctcttacaacagccagatgaccacgccgccacgacatctcttagttggaagcgggtcaagggctgcaaaagttcggaacagaacgggatggaacagaaaaccatcattctgattccatcagaccttgcatgcagactcctcgggcagagcatggacgagtcgggtctgcctcaactcacttcctatgactgcgaggttaatgccccaatccaggggtctcgtaatctactccagggtgaggaacttctgagggcattggaccaggttaac

SEQ ID NO: 33077 - DNA, 2478 bp, Artificial Sequence
  Description of Artificial Sequence: Synthetic coding sequence
atggagggggcaggaggcgctaacgacaagaaaaagatcagctcagaacgccgaaaagagaagtcccgggacgcggcacgctccagaaggtcgaaggagtcagaggtgttttatgaactggcccatcagctgccgctgccgcacaatgtctcaagccatttggataaagcctcagttatgcggctgaccatctcctatcttagagtgcggaagctcctggacgcgggcgacctcgacatcgaagatgatatgaaggcacagatgaattgcttctatctgaaggccctggatggtttcgtgatggtgctgactgacgatggagatatgatctacatctccgacaacgtgaacaaatacatggggctgacccagttcgagctgaccgggcattccgtgttcgacttcactcatccgtgtgaccacgaggagatgcgggagatgcttacccaccgcaacggcctggttaagaagggaaaggagcagaacacccaacgcagcttcttccttcggatgaagtgcacgctcacctcgcgcggacggactatgaatatcaagagcgccacttggaaggtgctgcactgcactggccacattcatgtgtacgacactaactcgaaccaaccccaatgcggatacaagaaaccgccgatgacttgcctggtcctgatctgtgaaccgattccacacccttccaatatcgaaatcccactggacagcaaaaccttcttgtcacgccactcactcgacatgaagttctcctactgcgatgaaaggatcactgagctcatgggatacgaaccagaggaactgctgggacgctccatctacgagtactaccacgcactcgactcggaccaccttactaagacccaccatgatatgtttaccaagggtcaagtgaccaccggccagtaccggatgttggcgaaaagaggaggatacgtctgggtggaaacccaagccaccgtgatttacaataccaagaactcacaaccgcagtgcatcgtgtgtgtgaattatgtggtgtccggtatcatccagcatgatctgatcttctccctgcagcaaaccgaatgcgtgctcaagccggtcgaatcgagcgatatgaagatgactcagctctttaccaaagttgagtcggaggatacctcgtcgcttttcgataaactcaaaaaggagccagacgccctcactctgttggcgcctgccgcgggagataccatcatctcactggacttcggctcgaatgataccgagacggacgaccaacagctggaggaggtgccgctgtacaacgatgtgatgctgccctcgccaaatgagaagctgcagaacataaatctcgcgatgtcccccctgcctacggcggaaactcccaagccgcttcggagcagcgccgacccagcgcttaaccaggaagttgccctgaaattggaaccaaacccggaatcgctggagctgtccttcaccatgccacagatccaagaccaaactccatccccaagcgacgggtcaacccgacaatcgagcccagagccgaactccccttcagaatactgcttctacgtggattccgacatggtgaacgaattcaagctggagctcgtggaaaaactgtttgcagaagataccgaagctaagaacccgttctccacgcaggacaccgacttggacctcgagatgctggcgccttacatccctatggacgacgatttccaattgaggtccttcgaccagctgtcccctctggaaagctcatccgcctccccggaaagcgcatcaccacaaagcaccgtgacggtgtttcagcagactcaaatccaggaaccgacggcaaatgccaccaccactactgctaccaccgacgaactcaaaactgtgactaaggaccgcatggaggacatcaagatcctcatcgccagcccgtcgcctacgcatatccacaaagaaaccacctcagctacttcgagcccgtaccgggacacccaatccaggaccgcctcgcccaaccgcgcgggcaaaggagtcattgaacaaaccgagaaatcacacccaaggagcccgaacgtgctgtcggtcgccctctcgcagcggactacggtgccggaagaggagctgaatccgaagatcctcgcactgcagaacgcccagcgcaagaggaaaatggaacacgatggatcgctgttccaggcagtgggtatcggaacgctgctgcaacagccggacgaccatgcagcaactacttctctgtcatggaagcgcgtgaagggctgtaagtcatcggaacagaacggaatggaacaaaagaccatcatcctgatcccgagcgacctcgcctgccgcctccttggacaaagcatggatgaatccggacttccgcagctgacctcatacgactgtgaggtgaatgcacctatccagggatcccggaacctgctccagggcgaggaactcctgcgcgccctggaccaggtgaac

SEQ ID NO: 33078 - DNA, 2478 bp, Artificial Sequence
  Description of Artificial Sequence: Synthetic coding sequence
atggagggcgcaggcggggccaatgataaaaaaaaaataagtagcgaacggcgcaaagaaaagtcccgggacgctgcaagatctcggaggtccaaagagagcgaagtgttctacgaattggcgcatcaacttcccctgccccacaacgtttccagccacctcgataaggcctcagtaatgagacttacaataagctacctccgcgtgcgcaagctcctggatgctggcgatctggatatcgaggacgatatgaaggcccaaatgaactgtttttatcttaaagccctcgacggattcgtcatggtcctgacagacgacggcgatatgatttatatctctgataacgtcaacaagtatatgggcctgacccagtttgagctgacaggccacagtgtgttcgattttactcacccatgcgatcatgaggaaatgagagaaatgctgacccaccgcaacgggcttgtcaagaaaggcaaggagcagaacacccaacggtccttcttcctgagaatgaagtgcacactgacttccaggggcagaacgatgaacattaagtcagcaacctggaaggtgctgcactgcactggacacatccacgtttatgataccaactccaaccagccacagtgtgggtacaagaaaccgcccatgacgtgtttggtactgatctgcgaacctatcccacacccaagcaatatcgagatccctttggactcaaaaacctttctgtccaggcactcactcgacatgaagttttcttattgcgacgaaagaatcacagagctgatgggctatgagcccgaggaactgcttggcaggtccatctacgagtactatcatgctctggacagcgaccatctcacaaaaactcaccacgacatgttcactaagggtcaagtgacaactggccagtacagaatgctcgcaaagcggggagggtatgtttgggtagagacccaggcaaccgttatatataacacgaaaaattcccagccccaatgcattgtgtgcgtgaactacgtggtgagtggcattatccagcatgaccttatatttagcctgcaacagactgaatgcgttctgaagcccgtagaatcatcagatatgaaaatgactcagctttttaccaaggtggagagcgaggacacctccagtctgttcgataagttgaagaaggaaccggatgcactgaccctgctggccccggccgcgggagataccatcatcagtcttgattttggatctaatgacaccgaaacagacgaccagcagctcgaggaagtccccttgtataacgatgtgatgctgcctagccccaatgagaagctgcagaacattaatctggcaatgtcacccctgccgaccgcagaaacccccaagcccctgcggtccagcgctgaccctgctctgaatcaggaggtagccttgaagttggaacccaaccccgagtcacttgagctgtcatttactatgccccaaatccaggatcagacccccagcccctccgacgggtctaccaggcagtctagccctgagcccaacagcccaagcgagtattgcttctatgtggatagcgacatggtcaacgagttcaagcttgagctggtggagaaactgtttgcggaggacaccgaggctaaaaatccattctccacccaagacactgatttggacctggagatgctggccccttacatcccaatggatgatgactttcagttgcgatccttcgaccagcttagcccgctggagtcatcctctgcctcccccgaaagcgcatcaccacagtccaccgtcacggtctttcagcagacacagatccaggaaccgaccgctaacgctacaacaacgaccgccacaaccgatgagctgaaaactgttacaaaagatcggatggaggacatcaaaattttgatcgccagtcccagccccacacacatacataaagaaactacctctgctacaagctctccctatagggatactcagtccaggacagcgagccctaaccgcgcaggaaagggagtcatcgagcaaaccgagaaatcccatccgaggtcaccaaatgtcctcagcgtggccctgtcacagagaacaaccgtgccggaggaggagctgaaccctaagattttggcactgcaaaatgcacagagaaagcgcaagatggaacacgatgggtccctgtttcaggcagtgggaatcgggaccctgctgcagcaacctgatgaccatgccgcgacgacaagtttgagttggaaaagggtaaaagggtgtaaaagcagcgaacaaaatggtatggagcaaaaaactattattctgatcccctctgatctggcatgtcgcctcctgggtcagagtatggatgagtcaggtctcccacaacttacaagttatgattgtgaagtaaatgctcccatccagggctctcgaaacctgctccagggtgaagaattgcttcgcgcactggatcaagtcaac

SEQ ID NO: 33079 - DNA, 2478 bp, Artificial Sequence
  Description of Artificial Sequence: Synthetic coding sequence
atggagggcgctggaggagctaacgataagaagaagatatcgagcgagagacgcaaggagaaatcccgggatgctgcgaggagcaggaggagtaaagagagcgaagtgttctatgagttagcccatcagctcccattacctcataatgttagtagtcacctggacaaagcttctgtgatgagactcaccatctcttacctccgggtgcgcaaactcttagacgctggggacctggatattgaagatgacatgaaggcacagatgaattgcttttacttgaaagcactggacggttttgttatggtgctcaccgacgatggagatatgatttatataagcgataatgtgaataagtacatgggcctgacgcagttcgagctcacagggcactccgtgtttgacttcacgcacccgtgtgatcacgaggaaatgagagagatgttgactcatcgtaatgggttggtcaagaaaggcaaggagcaaaatacgcaacggagtttttttctgagaatgaaatgtaccttgacctctaggggccgcacaatgaacattaaatcagcaacatggaaggtactgcactgcaccggtcacattcatgtttacgacaccaacagcaaccaaccccagtgtggctacaagaaaccaccaatgacctgcctcgtgcttatatgcgagcctatcccacacccatctaacatcgagatccctttagactccaaaacgtttctgagtcggcactctctcgatatgaagtttagttactgtgatgagcggatcacagagttaatgggatacgagccagaggaactgctgggccgcagcatctatgaatattatcatgcgctagactctgaccatctaactaagacccaccatgatatgtttactaagggtcaggttaccactgggcaataccgcatgcttgccaagcgtggtggctacgtttgggtcgaaactcaagccaccgtgatttacaataccaaaaattcacagccccagtgtatagtgtgtgtgaactacgtggtttccgggataattcaacacgacttaattttttccttacaacagacagaatgcgtgctgaaacctgtggagtcttcagacatgaaaatgacccagctgtttacaaaagtcgaatcagaagatacgagctcactgtttgataagctgaagaaggaacccgatgcattgactctccttgcacccgcagccggtgatacaataatctctttggatttcggtagtaacgatactgagactgatgaccagcagctcgaagaggtgcctctgtataacgacgttatgctgccatctcctaatgagaagcttcaaaacattaacctggctatgtctcctctgccaaccgctgaaactcccaagccattgcgcagtagcgccgacccagccttaaatcaggaagtagcgctaaagcttgaaccaaatccggaatccctggaactcagttttacgatgcctcagattcaggatcagactcccagcccatcagatgggagtacacgccagtcctctcccgagccaaatagcccttctgaatactgcttttacgtcgattccgacatggttaatgaattcaagctggaacttgtggaaaagctctttgccgaagacactgaggccaaaaatccattttctactcaggacacagatcttgatctggagatgctggcaccctatatcccaatggatgatgactttcagttgcgaagctttgatcagctgtcaccactggaatcctcttccgcctccccggagtctgcctctccacagtcaaccgtaaccgttttccagcaaacacaaattcaagaaccaacggctaatgcaaccacgacaactgctaccactgatgagcttaaaaccgttaccaaggaccgcatggaggacataaagatactgattgcttctccttcccctacccacatccacaaagagaccaccagtgccacaagcagcccataccgagatactcagagtcgcactgccagtcccaatagagctggcaagggggtgatcgagcagacagaaaagtcccatccacggtcccccaatgtactctcagtggccctctcacagcgaacaaccgtaccggaagaggaactgaatcccaagatcctggcactgcagaacgctcagcggaagagaaaaatggaacatgacggttccctatttcaagcggtcggtatcggtaccctcctgcagcagcctgacgatcacgccgcaactacctcactctcttggaagagggtcaagggctgtaagagctctgagcagaacggaatggaacagaagacaattattttgattccatctgatctggcgtgtcgtctacttgggcagtctatggacgaaagcggcctcccacagttaaccagttatgattgcgaagtgaatgcccccatccagggctcccggaacctgctccagggagaggagttactgcgggctctggaccaggtgaac

SEQ ID NO: 33080 - DNA, 2478 bp, Artificial Sequence
  Description of Artificial Sequence: Synthetic coding sequence
atggaaggagccgggggtgccaatgataagaagaagatatcctccgaaagacgcaaggaaaagagccgggacgccgcaaggtcgcggcggagcaaggaatcggaagtgttctacgagctggcacatcagcttccactgccacacaacgtgagcagccatctggacaaggcatcggtcatgagacttactatttcgtacttgagagtgcgcaaacttctggatgcgggtgaccttgacatcgaggacgatatgaaagcacagatgaattgcttctaccttaaggcccttgatggtttcgtgatggtgctcaccgacgacggagatatgatctacatttcagataacgtgaacaagtacatgggacttacgcaatttgagcttaccggccattcggtgtttgactttactcatccgtgcgaccacgaggaaatgcgtgaaatgctgacccacagaaatggactcgtgaaaaaggggaaggaacagaacacccaacgctcgtttttcctgcgcatgaagtgtactcttacttcccgcggcaggaccatgaatatcaagtcggccacctggaaagtgctccactgcacgggccacatccacgtgtacgataccaattcgaaccaaccgcagtgtggatacaaaaagcctcccatgacgtgtctcgtgctgatttgtgagcctatcccacacccgtccaacattgaaataccactggattccaaaacttttctgtcaagacatagcctggatatgaagttttcatactgcgacgaacggatcaccgagttgatgggatacgaaccagaagaactgcttggtcggagcatttacgaatactaccacgcactggattcagatcacttgaccaagacccatcacgatatgtttaccaagggacaggtgaccaccggtcaataccgaatgctcgcgaagaggggaggctatgtgtgggtcgaaacccaggcaactgtcatatacaatactaaaaactcacagccccagtgcatcgtgtgtgtgaactacgtggtgtcaggtatcatacagcacgacctgattttcagcctgcaacaaaccgaatgtgtgctgaagccggtggaatcatccgatatgaaaatgactcagctgtttactaaggtggagagcgaagatacttcgtcattgtttgataagctcaagaaagaacctgatgcactgaccctgttggcgccggccgcgggcgacactattatctccctggattttggctcgaacgataccgaaaccgatgatcagcaacttgaagaagtgcctctttacaacgacgtgatgctgccgtcccctaacgaaaagctgcaaaacataaaccttgctatgagcccgctcccaactgcagaaactcccaaaccactccggtcatcagcagatcctgcacttaatcaggaagtggcacttaagctggaacctaatcctgaatcactcgaattgtcatttacgatgcctcaaattcaagatcagaccccgtccccctccgatggcagcacccggcagtcctcgcccgagcccaactcaccctcggaatactgtttttacgtcgactccgatatggtgaacgagttcaagctcgagctggtggagaagctgtttgctgaagataccgaggccaaaaaccccttcagcacccaggacacggatcttgaccttgagatgctcgcaccttacattcctatggacgacgattttcaacttcgctccttcgatcaactttccccactcgaatcgtcaagcgcatcgcctgaaagcgccagcccacaatctaccgtcacggtgttccaacagactcagattcaagaacctactgcaaacgccaccaccaccacggcaaccactgatgaacttaaaaccgttaccaaggatcggatggaggatatcaaaatactgattgcaagcccttcccctactcatattcacaaggaaaccacgtctgcgacgtcgagcccgtacagagacactcaatccaggaccgcctcaccaaatagggcaggaaagggagtgatcgaacaaactgaaaagtcccatcccaggtccccaaacgtgctgagcgtggcactgagccagcggactaccgtgccagaggaagaactgaatccaaagatcctcgcactgcaaaacgcccagagaaagaggaagatggaacatgacggctctcttttccaggccgtgggaattggaacccttcttcagcaacccgacgaccacgcggcaacgactagcttgtcctggaagcgagtcaagggatgtaaatcttcggaacaaaacggcatggaacaaaagaccattatacttattccgtcggaccttgcatgtcgactcctgggccaatcgatggacgaatcgggtctgccacaactgacttcgtacgactgtgaggtcaacgcaccaatccagggatcccgtaacctgcttcagggcgaggagctgctgagggcactggatcaagtcaac

SEQ ID NO: 33081 - DNA, 2478 bp, Artificial Sequence
  Description of Artificial Sequence: Synthetic coding sequence
atggagggggccgggggggccaatgacaagaaaaaaatctccagcgagcggagaaaggaaaaatcccgggatgctgctaggtcccgacgctccaaggagtcagaggtgttttacgaattggcacaccagctccccctgcctcataatgtgtcctcccacttagacaaagccagcgttatgagacttacgatttcttatttgagagtaagaaagctcctggatgccggcgacctggatatagaagatgacatgaaggcgcagatgaactgcttctaccttaaggctctggatggcttcgtgatggtgctgacggacgatggagacatgatttacattagcgataatgtcaacaaatacatgggcctaactcagtttgagctaactggacattcagttttcgacttcacacacccatgcgatcatgaggagatgcgggaaatgttaacacatcgcaacgggctggtcaagaaggggaaggagcaaaatacccagcggagcttcttcctgcggatgaagtgcaccttaacaagcagaggcaggacaatgaacattaaatcggcaacatggaaggtccttcattgcactggtcacatccacgtctatgacaccaatagcaaccagccccagtgtggttacaagaaaccacccatgacttgcctggtcctgatctgtgagcctattccccatccttcaaacatagagatcccgttagactccaaaactttcctgtcccgccactctcttgatatgaagttttcgtactgcgacgaacggattaccgagttgatggggtatgagccagaagaactgcttggcagatccatttacgaatattatcatgcactggatagcgaccacctcacaaagactcatcatgacatgttcacaaagggccaggtcactactggccagtatcgcatgctcgccaagcgcggcggatacgtctgggtggagactcaggcaacggtgatctataatacaaagaacagtcagccgcaatgtatcgtatgtgttaactatgtggttagtggtattattcaacacgatctcattttttcacttcaacagacggagtgcgtgctcaagcctgtcgagtccagcgacatgaagatgactcagctctttaccaaggtggagagcgaagacacatcaagcctttttgacaaactgaagaaggagccagatgctcttacactgctggcgcccgccgccggggatacgataatctctttagacttcggctcgaacgatactgagacagatgatcagcagttagaggaggtacccctgtataatgatgttatgcttccatccccgaacgagaaactgcaaaatatcaacttggctatgtcccctctgccaaccgccgagaccccaaagcccctgaggtcttcagcagacccagcccttaatcaagaagtcgccctgaagttggaaccgaaccctgagagcttggagctgtccttcacgatgccacaaatccaggaccaaacaccttcccccagtgacgggagcacgcggcagtcttcccctgagcctaattcaccttctgagtactgcttctacgtggacagcgacatggtgaacgagttcaagttggaattggtggagaaattatttgcggaagatacagaagccaagaaccctttttcgacgcaggatacagatctggatttggaaatgctggctccttatatcccgatggatgatgactttcaactgcgttccttcgatcaactttcacccttggaaagctctagcgcgagccctgaatctgccagtccgcagtccaccgtgaccgtgtttcagcagacccagatccaagaaccaacagctaatgccacgaccaccaccgcaactacagacgaactgaagaccgttaccaaggacaggatggaagacattaaaatattgatcgcaagcccttcgccaactcatattcacaaggaaacaacatccgcgacgagcagtccctatcgcgatacccagtcacgaacagccagccctaatagagctggaaaaggcgtaattgagcagactgaaaagtctcacccgcgctctccaaatgtcctcagtgtcgcccttagccaacgcacgactgtgcccgaagaggagctcaacccaaagatcctcgccctgcagaatgctcagcgcaaaaggaaaatggagcacgacgggtctttgtttcaagctgtcgggattgggactctgctgcagcagccagatgaccacgccgcaaccaccagtctgagctggaagagagtgaagggctgtaagtcctctgagcagaacggaatggagcagaagacaattattctcataccatctgacctggcctgtcgtctgctcggccagagcatggacgagtctggactgcctcaactgacctcttacgattgcgaagtgaatgcaccaatccagggaagtcggaatctgctacagggcgaggaacttctcagggctttagaccaggtaaat

SEQ ID NO: 33082 - DNA, 2478 bp, Artificial Sequence
  Description of Artificial Sequence: Synthetic coding sequence
atggaaggggctggtggagctaatgataagaagaagatctcatcggagagacggaaagagaaaagccgggacgcagcccgctcccgccggagcaaagagtccgaagtgttctacgagctggcgcaccaactcccactgccgcacaatgtctcatcacatctggataaagcctccgtgatgcggcttaccattagctatcttcgcgtgagaaaactgctggacgccggcgaccttgatatcgaagatgacatgaaagcgcaaatgaattgtttctatctgaaagcgctggatggattcgtgatggttctcactgatgacggcgacatgatctacattagcgacaacgtcaacaagtacatggggctgactcaattcgagctgaccggacattccgtctttgacttcactcacccctgcgaccacgaagaaatgagggaaatgctcacccaccgcaacggactggtgaagaagggaaaggaacagaacacccagcgttcctttttcttgcggatgaaatgcacccttactagcagaggccggacgatgaatattaagtccgccacctggaaagtcttgcattgcactggacacatccacgtctacgataccaactcaaatcagccgcaatgtggatacaagaagccgccgatgacctgtctcgtgttgatatgcgaaccgatccctcacccatcgaacatcgaaattccactcgacagtaagacttttctgtcccggcacagcctggatatgaagttctcctactgcgacgaacgcatcaccgagctcatgggatacgagccagaagagctgctgggcaggtccatctacgaatactaccacgccctggacagcgatcatctgaccaagacccatcatgatatgtttaccaagggacaggtcacgaccggccaataccgcatgctggccaagcgaggaggttacgtgtgggtggagactcaggcaacggtcatctataacactaagaactctcagccgcagtgtatcgtttgcgtcaactacgtcgtgtcgggtatcatccagcacgatctgatcttttcgctgcagcagactgaatgcgtgcttaagcctgtggaatcctcggacatgaagatgacccagctgttcaccaaggtggaatcggaggacacctcatctctgttcgacaaactcaagaaggaacctgacgctctgaccctcctggcgccggcagcaggagacaccatcatctcactcgacttcggaagcaatgacactgagactgacgatcagcagttggaggaagtgccgctctacaacgacgtgatgctgccttcaccaaatgagaaattgcaaaacatcaatcttgccatgtcaccgctgcctacggccgaaaccccgaagccactcaggtcgagcgcagaccctgcccttaaccaggaggtggctttgaagctggagccgaatcccgagagcctcgagctctccttcaccatgccacaaattcaagaccaaactccgtccccgtcggacggatcaactagacaatcatcccctgagccgaactcgccatccgaatactgcttctacgtcgatagtgacatggtgaacgaattcaagctggaactggtggagaagctgttcgcagaggacacggaggcgaagaatccatttagcacccaagatactgacctggaccttgaaatgctcgcaccctacatcccgatggacgatgactttcaattgagatcgttcgaccagttgtcccccctcgagtcaagctctgcgtcgccagaatccgcaagcccacagtccactgtcactgtgttccagcagacgcaaatccaagagcctaccgccaacgcaactactactacggcgaccaccgacgaactcaaaaccgtgaccaaggatcgcatggaagatatcaagattctgatcgcttcgcccagcccgactcacatccataaggagactacttcagccacttcgtcgccgtaccgggacacgcagtcgcggaccgcttcaccgaatagagcggggaagggggtgattgagcaaaccgagaagtcccatccgcgctcgcctaacgtgctctccgtggccctgtcgcagcgcactaccgttccagaagaagaactgaatcccaagatcctcgctctccagaacgcccaacgaaagaggaaaatggagcatgatggatccctgttccaggcggtcggtatcggaactcttctccagcagccggatgatcacgccgccaccacctcgctgtcatggaaaagagtgaagggttgcaaatcgagcgagcaaaacggcatggaacagaaaactatcatcctgatcccatcggacctcgcctgccgcctgctcggacagtcaatggatgaaagcggcctcccccagctgacctcgtacgattgcgaagtgaacgccccgatccagggcagccggaacctgctgcagggggaagaactgttgcgcgcgctggatcaggtgaac

SEQ ID NO: 33083 - DNA, 2478 bp, Artificial Sequence
  Description of Artificial Sequence: Synthetic coding sequence
atggaaggcgcagggggggccaatgataaaaagaagattagctccgagcgaaggaaggagaagagtagggacgcagctcggtctcgacgctctaaagaatctgaggtgttctacgagctagcccatcagctgcctctgccacacaacgtgtcctctcatctggataaggcatcagtcatgagactgacaattagttacctgcgggtcagaaagctcctcgatgcaggagatctggacattgaggacgatatgaaggcccagatgaactgcttctacctgaaggccctggacgggttcgttatggtgctgacagatgacggcgacatgatatatatctcagacaatgtgaacaaatacatgggcttaacacagttcgaactcaccggtcattctgtctttgatttcacccacccatgcgatcatgaggagatgagggaaatgctgactcaccgcaacggtctggtaaaaaagggcaaagagcagaacacacagcgatctttctttctaagaatgaaatgtaccctgacaagtcggggacgcactatgaacatcaagagcgccacttggaaggtcctgcactgcaccggccacatacatgtgtacgatacaaacagtaaccaacctcagtgtggatataagaagccaccaatgacctgcctagttctgatatgcgagcctattcctcacccatctaatattgaaattcctcttgactctaagactttcctatcacgacattccctcgacatgaaattcagctattgtgatgagaggatcaccgagttgatgggctatgaacccgaggagctgcttggcagatctatttacgagtactaccacgcactggatagtgatcaccttaccaagacccatcatgacatgtttactaagggacaggtgaccactggccagtacagaatgctagccaagcgaggtggctatgtgtgggttgaaacccaggcaacagtgatttataacaccaagaattcacaaccacagtgcatagtgtgcgtgaactacgtcgtaagtggaatcatacagcacgacctgattttcagcctacagcagacagagtgcgttcttaagccagtagaaagcagcgatatgaaaatgactcaactattcaccaaggtggaaagcgaggatacatcttcactattcgacaaactgaagaaggaaccagacgccctcactctactggcccccgccgccggggacaccataatctccctggattttggctctaacgatactgagaccgacgatcagcagctggaggaggtgccactttataacgacgttatgctcccatcaccaaatgagaaattacagaatattaacctggccatgagccccctgcccaccgccgaaaccccgaagccacttaggtcaagtgcagaccctgctttaaatcaggaggttgccctaaaactcgaaccaaatcctgagtcattagaactatcctttaccatgccacagattcaggatcagaccccaagcccatccgacggcagcacaaggcagagcagccctgagcctaactctccctctgagtactgcttctacgtggacagcgacatggtgaatgaattcaagctggaattggttgaaaagctgtttgccgaagataccgaagcaaaaaatccatttagtacccaggatacagatctggatctagagatgctggccccatacatacccatggatgatgatttccaactgcgaagcttcgaccaactatcccctctagagtctagttctgctagtcccgaatcagcatccccacagtctacagtgaccgtgttccagcagacccagatacaggaacctaccgccaatgctacaacaaccaccgctacaaccgacgagctgaagaccgtcaccaaggaccgtatggaggacatcaaaatcctgattgccagccccagtcccacccatatccataaagaaacaacatcagccacctctagtccatacagagacacacagtctagaaccgccagcccaaacagggcaggaaaaggggtgatagagcagacagaaaagtcccacccaaggagtcccaacgttttatctgtggctctttcacagaggaccaccgtccccgaagaagagttgaatcctaaaatcttggccctccagaacgctcagcgaaagcgcaaaatggaacacgacggctccctttttcaggctgtcggaattggtactctactccaacagcccgacgatcatgcagctacaacttcattgtcctggaaacgtgtcaaggggtgtaagtcctcagaacaaaatggcatggaacagaaaaccattattttgattccatctgatctggcttgtcggctcctgggacagagtatggatgagtctgggctgccccaactgacttcctacgactgcgaagtcaacgctccaatccaaggttcacggaatttgctgcaaggagaggagctgctacgcgcactggatcaggttaat

SEQ ID NO: 33084 - DNA, 2478 bp, Artificial Sequence
  Description of Artificial Sequence: Synthetic coding sequence
atggagggggccggcggagcgaacgacaaaaagaagatttcctctgagcggagaaaagaaaaatccagggacgctgctcggtcaaggagaagcaaggagagcgaagtgttctacgaactcgcgcatcagctgccgctcccccataacgttagttcccatttagataaagcttcggtgatgagactgaccatctcctatctacgggttcgcaagctgctggacgccggagatctggacatagaggatgatatgaaggcccagatgaattgcttctacttgaaggcactcgatggcttcgtcatggtgctgaccgacgatggagatatgatttacatttctgataacgtaaacaagtacatgggcctgactcagtttgagctgactgggcattctgtgtttgattttacgcatccgtgcgaccacgaagaaatgcgagagatgctgactcataggaatggtctggttaagaaagggaaggagcagaacacccagcgatctttctttctcagaatgaagtgcactctgaccagcagaggtcggaccatgaatataaagagtgccacgtggaaggtgctgcactgtaccggtcatatacacgtctatgataccaattcaaaccagcctcagtgtggctataagaagccccccatgacgtgcttagtactcatatgtgaacccattcctcacccatccaacatcgaaattccactagattctaagactttcttatcgaggcattcactggacatgaagttcagctactgtgatgaacggataacagagttgatgggctatgagcctgaagagctgctggggaggtctatctatgagtattaccacgcgttggactcagatcacctcaccaagacacaccatgacatgttcaccaagggacaggttactactggccaataccgcatgctggctaagcgggggggctacgtgtgggtggaaactcaggcgactgttatctataacacgaaaaatagtcagcctcaatgcattgtatgcgtgaactacgtggtgagtgggattatccagcacgatttgatttttagtctgcagcagaccgaatgtgtgctaaaacccgtggaaagctctgatatgaaaatgacacagctgtttacaaaagtggagtcagaagataccagttctctatttgacaaactcaaaaaggaacccgatgccctaaccctactagcccccgctgcaggcgatacaattatcagcctagacttcggttccaatgataccgaaaccgacgaccaacagctcgaagaagttcctttatataatgatgtgatgctcccctccccaaacgaaaagctgcagaatataaacctcgctatgtccccactgcctaccgccgaaacgccaaagcccctccgcagtagcgcagacccagctctgaatcaggaggtggcattgaaactcgaacctaatcctgagagtctcgagttgagttttactatgccacagatacaagatcagacaccatcaccctcggacggctccacacggcaaagctcccctgaaccaaattctccgtctgagtattgcttttacgtagactccgacatggtcaacgaattcaagctggagttggtcgaaaagctctttgctgaagatacagaagccaaaaatccgttctcaacacaggacacagacctggatctggagatgctggcaccatacatacccatggacgatgatttccaactgagaagtttcgaccaactgtcccctttggagagcagctcagcatcacctgagtcagccagtcctcagtctaccgtgactgtattccagcagacacagatccaggaacctacagctaatgctactactacgaccgctacaacggacgagctgaaaacagtgaccaaagaccgaatggaggacatcaagattctgatcgccagcccttctccaacccatatccacaaagaaactacaagcgccacttcaagtccctacagggatactcaatctagaacggcttcccccaacagggctgggaagggggttatagagcagacagaaaaatcgcacccaaggagccctaatgtgctcagcgttgccctttctcagaggaccactgtccccgaagaagagctgaatcctaaaatcttggcccttcagaacgctcagagaaagaggaagatggaacacgatggaagtctcttccaggccgtggggataggcacactgctgcagcaaccagatgatcatgcagccaccaccagcttgtcctggaagcgagtgaaagggtgcaagagctccgaacaaaatggcatggagcagaaaaccattatcttgatcccatccgatcttgcctgcaggctgctcggacaatcgatggacgagtcgggcctgccgcaactgaccagctacgactgcgaggtgaatgctccaatccaaggctctcggaacctgctgcagggagaggagctgctcagggctctggatcaggtcaat

SEQ ID NO: 33085 - DNA, 2478 bp, Artificial Sequence
  Description of Artificial Sequence: Synthetic coding sequence
atggagggcgccggcggagccaatgacaagaaaaagatctccagcgaaagacggaaagaaaagtcgcgggacgcggcccgctctcgccggagcaaggaatctgaggtgttctacgaattggcgcatcaactgccgcttccgcataacgtctcgtcgcacctggataaagctagcgtgatgcggctcactatctcctacctgcgggtgcgcaagctcctcgacgcaggcgatctcgatatcgaagatgacatgaaggctcagatgaattgcttctaccttaaggcactggacgggttcgtgatggtgctgactgacgacggagatatgatctacatctccgacaatgtgaacaagtacatgggactcacgcagttcgagttgaccggacactccgtctttgacttcacccatccgtgcgatcacgaggaaatgagagagatgctgacccacagaaacgggctggtgaagaagggtaaggagcagaacactcaaagatccttcttcctcagaatgaagtgtaccctgacctcaaggggacgaacgatgaacattaagtcggcgacttggaaagtcctccactgcaccggccatatccatgtgtacgacaccaactcaaatcagccgcagtgcggatacaagaaaccgccaatgacttgcctggttctcatctgtgagccgatcccgcacccaagcaatatcgaaatcccgctggattccaaaaccttcctgtcgcggcactccctcgacatgaagttttcatactgcgacgaaaggattactgaactgatgggctacgagccagaagaactgctgggaaggtcgatctacgagtactaccacgctttggactccgaccacctcacgaaaactcaccatgatatgttcactaagggccaggtcacgaccggacaataccgcatgctggccaaacgcggcgggtacgtgtgggtggaaactcaggctacggtgatttacaatactaagaattcccagcctcaatgcatcgtgtgcgtcaattacgtcgtgtcgggaatcatccagcacgacctgatcttctcactgcagcagactgaatgcgtcttgaagccggtggagtcctcggacatgaaaatgacgcagctgttcaccaaggttgagtcagaggacacctcatcactgtttgacaagttgaaaaaagagccggacgctcttaccttgctggcaccggccgccggggacaccattatctcccttgactttggaagcaatgacactgagacggatgaccagcagctggaggaggtgcctctgtacaacgacgtgatgctgccgtcaccaaacgagaagctgcagaacatcaatctcgcaatgtcccccctgcccaccgccgagactccaaaaccactccgctcgtctgccgacccggctctgaaccaagaggtggcactgaaactggaaccgaacccggagtcccttgagctttcgttcaccatgccacagatacaggatcagactccaagcccgtctgacggatcgactcgccagtcctctccggagcctaatagcccgtccgaatattgcttctacgtggacagcgacatggtgaatgaattcaaactggaactggtggaaaagctgttcgcggaggacaccgaggccaagaacccgttctccactcaggacactgacttggatctggagatgcttgcaccatacatcccgatggacgacgattttcagctgagatcctttgatcaactcagcccgctcgagagctcgtcggcgtcccccgagagcgcctcacctcaaagcaccgtgactgtctttcagcagacccagattcaagagccgaccgcgaacgcgaccactactaccgccactactgatgagttgaaaaccgtgactaaggacagaatggaggacatcaagatcctcatcgcgtcgccgtcccccacgcacatccacaaggagactacctcggccacctccagtccatacagagatacccaatcaagaactgcctcgccgaaccgcgcgggaaaaggagtgattgaacaaactgaaaagagccatccgagatccccgaacgtgctgagcgtcgcactctcgcaaaggaccaccgtgcccgaagaagagctgaatccgaagatcttggccctccagaacgcccagcgcaagagaaaaatggaacatgacggatcactgttccaggccgtcggcataggcactctcctgcagcaaccggacgatcatgcagccaccacttcactctcctggaaaagagtgaaggggtgcaagtcctcagaacaaaacggaatggaacagaaaaccatcatcctgatcccctccgatctggcctgccgccttctgggccagtcaatggatgagtctggactgccacagctcacttcatacgattgcgaagtcaacgcacccatccagggttcgaggaacttgctgcaaggagaagaactcctgcgcgccctggatcaagtcaac

SEQ ID NO: 33086 - DNA, 2478 bp, Artificial Sequence
  Description of Artificial Sequence: Synthetic coding sequence
atggagggagccggaggcgcaaacgacaagaaaaagatttcgagtgaaagaaggaaagagaagagccgcgatgccgcccgatctcgacgctcaaaggagtctgaggtgttctatgagcttgcccaccagctgccgctgccccacaacgtctcttctcacctggataaagcctctgtgatgcgcctgactataagttatcttcgcgttaggaaactcctcgatgccggagatttggacatagaggacgatatgaaggcccaaatgaactgtttctacttaaaagccctggacggtttcgtcatggtactgaccgacgacggagacatgatatatatcagcgataacgtgaacaaatacatggggctgacccagtttgaactcacgggacacagcgtttttgattttacacacccatgtgaccatgaagagatgagagagatgctgacacatagaaatggtctcgtgaaaaagggcaaggaacaaaacactcagcgttctttcttcctgcggatgaaatgtactttgacatcacgcggaaggacaatgaatattaaaagcgccacttggaaagttctccattgtactgggcatattcatgtctacgacactaattcgaaccagccccagtgtggctacaagaagccacccatgacttgtctggttctaatctgcgagccaatccctcacccttcaaatattgaaataccgctggatagtaaaacctttctatctcgacattctttggatatgaaattcagttattgcgatgagcggataaccgagctgatggggtacgagccggaggagctgctagggcgcagtatctacgagtattatcacgcgctcgatagcgatcacctcaccaaaacccaccatgacatgtttacaaagggccaggtcacaaccggccagtataggatgttggccaagaggggcggctacgtctgggtcgagacgcaggctacggtcatctacaataccaaaaattcccagcctcagtgcatcgtgtgtgtaaactacgtcgtgtcagggataattcagcatgacttaatcttctcactgcaacagacagagtgtgtattgaagccagtcgaaagcagtgacatgaagatgacccagctttttacgaaggtggagagcgaggacacttcctccctgtttgacaagctcaaaaaggagcccgatgccttgacactactggcccccgccgccggtgataccataattagtctggattttgggtccaatgatactgaaaccgatgatcagcaattggaggaggtaccgttgtataacgacgtgatgctgccaagtcctaacgagaaactgcagaatattaatcttgcaatgtcccccctgccgaccgctgaaaccccgaaaccactaagaagcagcgcagatcccgctcttaatcaagaagtcgctttgaagcttgagcccaaccctgaatctcttgagttgagcttcaccatgccgcagatacaggatcaaacaccctctccctcagatggctcaacccggcaatcttctccagaaccgaatagcccatctgagtattgtttttatgtcgactcagatatggtaaacgaattcaaactggaattggttgagaaattgtttgccgaagacacagaggctaaaaatcccttctcaacacaggataccgacttggatctggagatgctggctccctacattcctatggacgatgactttcaactcagatctttcgaccagctgtcccccctggagtcaagctcggccagtcctgaatcggcgtctccccagagtaccgtaaccgtgtttcagcaaacacagatccaggagcctacggcaaatgcaacaacgacgaccgctacaaccgatgagctgaagacggtgactaaagacaggatggaagacatcaagatactaatcgctagcccttctccaacacacattcacaaggagaccacaagcgccacaagttccccttatagggatacacagtccaggaccgccagcccaaatagggctggaaagggggtgatcgaacagaccgagaagagccaccctcgcagtcctaatgtactatccgtggcgctctctcaacgaaccaccgtaccagaagaagagctgaatccgaaaatacttgctctccagaatgcccagcggaagcgcaagatggagcacgacggaagcctttttcaggccgttggcattgggactctgctgcagcaaccagatgaccatgccgccactacttctctaagttggaaacgcgttaaggggtgcaagtcgagcgaacagaacggaatggaacaaaagactatcatcctcatcccttctgacttggcctgtcgcctcctgggacaaagcatggatgagagcggtctaccccaattgacttcctacgactgtgaggtgaacgcacccattcagggtagccgcaatttgctgcaaggtgaggagctgctcagggcgctggaccaagtgaac

SEQ ID NO: 33087 - DNA, 2478 bp, Artificial Sequence
  Description of Artificial Sequence: Synthetic coding sequence
atggagggtgccggaggcgccaacgacaagaagaagatcagctccgagagacggaaggagaagtcgcgcgacgccgcccggtcaaggcgctctaaagaatcggaagtcttttacgaactcgctcaccagcttccgctcccccataatgtgtccagccatctggacaaggcctccgtgatgcggctgactatttcataccttagggtgagaaaattgctcgatgccggggacctggacatcgaagatgacatgaaggctcagatgaattgcttctacctcaaggccctggatggattcgtcatggtgctcactgacgacggggacatgatctacatcagcgacaatgtcaataagtacatgggattgacccagttcgaattgaccggccattcagtgttcgacttcactcatccgtgtgatcacgaagagatgagagagatgctgactcatcggaatggacttgtcaagaagggcaaagaacaaaacacccaacggtccttcttcctgcgcatgaaatgcactctgacctcaaggggccggacgatgaacatcaagtccgcgacttggaaggtgctgcactgcaccggacatatccatgtctacgatactaactccaaccagccccaatgcggctacaagaagccgccaatgacttgcctggtgctgatttgtgaaccaattccgcatccgagcaatatcgagatcccactcgactcgaaaactttcttgtcccgacactcgctggatatgaagttttcatactgcgatgagcgcatcactgaactgatgggatacgagccggaagaactcttgggccgcagcatctacgaatactaccacgctctggactcggaccatctgaccaagacccaccacgacatgttcaccaaaggacaggtcactactggacagtaccggatgctggcgaaacggggcggatacgtgtgggtggaaacccaggccaccgtgatctacaatactaagaattcccagccgcaatgcatcgtgtgcgtgaactacgtggtgtcagggatcatccagcacgacctgatcttcagcctccagcaaacggaatgcgtgctgaagcccgtcgaaagctccgacatgaagatgacccagcttttcactaaggtcgagtcggaggacacctcgtcgctcttcgacaagctcaagaaagaaccggacgcgctcacccttcttgcgccagcggccggagacaccattatctccctcgacttcggatcgaatgacactgaaacggatgatcaacagctcgaagaagtgcctctttacaatgatgtgatgctgccgtcacccaacgagaagttgcaaaacatcaatttggccatgagcccgctgccgactgctgagacgcctaagccactgagatcctcggcagatccggcgctcaaccaggaggtcgctttgaaactcgaaccgaaccccgaatccctggaactcagcttcaccatgcctcagatacaagaccagacgccatcgccatcggatggttcgacccgccaaagctccccggagccgaactcgccgtcggagtactgcttctacgtggactcggacatggtgaatgagttcaagctggaactcgtggagaagctgtttgctgaagataccgaggccaagaacccgttctcaacgcaggataccgatctcgacctcgaaatgctggcgccctacatccctatggacgacgacttccaactccggagcttcgaccaactgtctccactggagtcatcttccgcgagcccggaaagcgccagcccacagtcgaccgtgacggtgttccagcagactcaaatccaagaacccaccgccaacgccactacgactaccgccactaccgacgaactgaaaactgtcactaaggacaggatggaggacatcaagatcctgatcgcatctccttcgcctacccatatccacaaggagactacttccgccacttccagcccgtatagggacactcagtcgcggaccgcctcgccgaatcgcgccgggaaaggagttattgaacagactgagaagtcccatccaagatccccaaacgtgctgagcgtggcgctgtcccaaagaaccactgtcccggaagaggaactgaaccctaagatccttgctctgcagaacgcacagcgaaaaagaaaaatggagcacgatggatcactgtttcaggctgtggggatcggaactcttcttcagcagccagatgaccacgcagcaaccacctcgctgtcgtggaaaagagtcaaggggtgtaagtcctccgaacagaacggaatggagcagaaaaccatcattctgattccaagcgatttggcatgccggcttctgggacagtcaatggacgagtcggggctccctcagcttaccagctacgactgcgaggttaacgcgccgattcagggatctcgcaatcttctccaaggtgaggagctgctgcgggccctcgaccaagtgaac

SEQ ID NO: 33088 - DNA, 2478 bp, Artificial Sequence
  Description of Artificial Sequence: Synthetic coding sequence
atggaaggtgccggcggagccaacgacaagaagaagatatcgtcggagagaagaaaggagaaatcgcgggacgcagcaagatctcgaaggtccaaggaatcggaagtgttttacgaattggcccaccagcttccactgccacataatgtatcctcccatttggataaagctagcgtgatgaggctgactatatcctacctgcgggtccgaaaactgctggacgctggcgacctggacatagaagatgacatgaaggcacaaatgaactgtttttacctgaaagcgctggatgggtttgtcatggtgctgactgatgatggagatatgatttacatcagcgacaatgtgaacaaatacatgggacttacccaatttgagctgaccggacattcagtgtttgatttcacccatccttgtgatcacgaagaaatgagggaaatgctcactcaccgaaacggacttgttaagaaaggcaaggagcaaaatacccagcgttcattctttctccgtatgaagtgtacgttgactagcagaggacgtactatgaacattaagtcggcgacctggaaggtgctgcattgcacgggacacatccacgtgtacgacaccaacagcaaccagcctcagtgtggttacaagaagccgccaatgacctgcctggtgctgatctgtgaacccatcccacatccttctaatatcgaaatcccattggactccaaaaccttcctgtcacgccactcgcttgatatgaagttttcttactgtgatgaaaggatcactgaacttatgggttacgagcccgaagaactgcttgggcgctcaatttacgagtactaccatgcacttgatagcgaccatctgactaaaacccaccatgatatgtttaccaagggacaagtgaccaccgggcagtatcggatgctcgccaagagaggtggatacgtgtgggtcgaaactcaggcaactgtgatttacaatactaagaattcgcaacctcagtgcatagtgtgtgtcaattacgttgttagcggcattatacaacatgacctgattttctcactgcagcaaaccgagtgtgtcctgaaaccagtggaatcgagcgacatgaagatgactcaactctttaccaaagtggaatccgaggacactagctcccttttcgataagctgaagaaggagccggatgcacttacgcttctcgctcccgcggccggagacaccatcataagccttgattttggtagcaatgataccgaaaccgatgatcaacagctggaggaagtgcctttgtataacgacgttatgcttccttcccctaacgaaaagctgcagaacatcaaccttgcgatgtcgcctctgccaactgcagaaactccgaagcctcttaggtcgtctgcagatcctgcactcaaccaagaagtggctctgaaactcgaaccaaaccctgaatcccttgaacttagcttcaccatgccacaaattcaggatcagaccccttcgccttcagacggatcgaccagacaaagctcgcctgaacctaatagcccaagcgagtactgtttttacgtggattcagacatggtgaacgagtttaagctggagttggtggagaagctgttcgctgaagataccgaagccaagaatcctttttccactcaggacactgatcttgaccttgaaatgcttgcaccttacattccaatggatgatgattttcagctgcggtcgttcgaccaactgagccctctcgaatccagctcggctagccccgaatcggcaagccctcagtccacggtgactgtgtttcaacagacccagattcaggaaccgaccgcaaacgcaactacgaccactgcaaccactgatgagctcaagaccgtgaccaaggataggatggaagatatcaagattcttatagctagcccgtcgcctacccatatccataaggaaaccacttcggcaacgtcatccccataccgagatactcaatcccgaacggcctcgccaaaccgcgcaggaaagggggtgatcgagcagactgaaaagagccaccctagatcaccaaatgtgctttcggttgccctgagtcagagaaccaccgttcctgaggaagaactgaatcccaaaattctcgccctccagaacgcacaaaggaaaagaaagatggaacacgatggtagccttttccaggcagttggcattggaaccttgctgcaacaaccagatgaccatgctgccaccacctcgctgtcgtggaaacgggtcaagggatgcaagtcaagcgaacaaaacggaatggagcaaaagactatcattctcatcccttcagatcttgcatgcagacttcttgggcaatcaatggatgagtcgggccttcctcaacttactagctacgattgcgaagtgaacgctcccattcagggatctcgaaaccttctccaaggcgaggaactgctccgggccctcgaccaagtgaac

SEQ ID NO: 33089 - DNA, 2478 bp, Artificial Sequence
  Description of Artificial Sequence: Synthetic coding sequence
atggaaggcgcaggaggtgctaacgataagaaaaagatttcttcagaacgtcgaaaagagaaaagtcgtgacgcagcgcgttcacggcgtagtaaggaatccgaagtgttctacgagctagctcatcagctaccgcttccccacaacgtgtcttcacatttggataaagcgtctgtcatgagactgaccatatcatacttaagagtccggaagttgcttgatgctggggatttggatatcgaagacgacatgaaagcacagatgaattgtttctatttgaaagcacttgatggattcgtgatggtgcttaccgatgatggtgacatgatctatatttctgataatgtaaataaatatatgggattgacgcaattcgaattaacaggccactctgtgttcgatttcacacacccttgcgatcacgaggaaatgagggaaatgttgacacaccgaaacggtttagttaaaaaaggcaaggaacaaaatacacagagatctttttttcttcgtatgaaatgcacactaacgtcccgcggaagaacaatgaatattaaatctgctacatggaaagttctacactgcacgggtcacattcatgtctacgatactaactctaatcagccgcaatgcggttataagaagccgccgatgacttgcttggtgttaatttgcgagcctattccacatccgtccaatatcgagattccattggattccaaaactttcttgtctcgacacagcttggatatgaaattcagttactgcgatgaacgaattaccgagcttatgggctacgaacctgaggaacttttgggcagatctatctatgaatattatcatgcacttgatagcgatcacttgactaagacccatcatgatatgtttacgaagggacaagtcactactggtcaatatagaatgctggcgaaacgtggaggttatgtctgggttgaaactcaggccactgtgatctacaacacaaagaactctcagccacaatgtattgtttgcgttaactatgttgtatccgggattattcagcacgatcttattttcagtctacaacaaaccgagtgcgtcttgaagccagttgaatcaagtgatatgaaaatgactcagctttttacgaaagttgaaagtgaagacacgtcgtcgctctttgacaaactgaagaaagaaccagatgctctaacattgctcgcaccagcagctggtgacactattatttcactcgattttggatccaacgataccgagaccgatgatcaacagcttgaagaggtgccgctctacaacgacgtcatgttacccagcccaaatgagaaactccaaaacattaatctcgctatgtcccctctacctacagctgaaactccgaaaccactcaggtcaagtgctgatccagctttgaaccaagaggtcgccctcaaactggaacccaatccagagtcgctcgaattgtcttttacaatgccacaaatacaagaccaaaccccatcaccctcagacgggtcaacacgacagtcgtctccagaaccaaatagtccatcagaatactgtttctatgttgatagtgatatggtcaatgaattcaagcttgagttggttgagaagttgttcgctgaggatacagaagcaaaaaaccctttcagtactcaggacacggacctggacttggaaatgctggcgccatacatcccgatggacgatgacttccaattacggagtttcgatcagctgagcccattagagtcatcctctgcatctcctgaaagcgcttctcctcagtcaacggttacggtgttccaacaaacccagattcaagaaccgacagctaatgctacaactactacggccaccacagatgaactgaaaacagttacaaaagatcggatggaggatattaagatcttgattgcatcgccctcacccacccatatacataaagaaactacgagtgccacaagctctccttatcgggatacacaatcccgaactgcatcaccaaatagagctggcaagggagttatagagcaaacggaaaaaagccacccaagatcgccaaatgtcctgtccgtagctctttctcaaagaactacagttccagaggaagaattaaatccgaagatcctggcacttcaaaacgcgcaaagaaaaagaaaaatggaacatgacgggtcactgttccaggctgttggcattgggacacttcttcaacaacctgatgaccatgctgccacaactagcctctcatggaaacgtgttaagggatgtaaaagctcagaacaaaatggaatggagcagaaaacgattatattgattccatcagacttggcttgcagattgttggggcaatctatggatgaatcaggactcccacaactcacctcctacgactgcgaagttaacgctccaattcagggatcaagaaacttgttgcaaggagaggaattgttgagggcgttggaccaagttaac

SEQ ID NO: 33090 - DNA, 2478 bp, Artificial Sequence
  Description of Artificial Sequence: Synthetic coding sequence
atggagggggccgggggggcgaatgataaaaagaagatttcctccgagaggcggaaggagaaatctcgagatgccgctcgctcccgcagaagtaaagaaagcgaagtcttctatgagctcgctcaccagttgcccttgccgcacaacgtcagctcccatttagacaaggcctccgtgatgcgtctgaccatctcttatctgagagtgagaaagcttctggatgccggtgacctcgacatcgaggatgacatgaaagcacaaatgaattgtttctacttgaaggccctcgacggattcgtgatggtgctgactgatgacggcgacatgatttatatctctgacaatgtgaacaagtatatggggcttacacaattcgaacttaccggccatagtgtctttgatttcacgcacccgtgtgaccacgaggagatgagagagatgttgactcaccgcaatgggctggtgaagaagggtaaggaacagaatacacagcgaagcttctttctgcgaatgaaatgcacactgacttcaaggggccgaaccatgaacattaagtctgcgacatggaaagtcttgcactgtacgggccacatccacgtctatgatacgaattctaaccagccacagtgcggctataagaagccgccgatgacttgcctcgtgctgatttgcgaacccattccacaccctagcaacatcgaaattcccctggattctaagacttttctctcacggcattctctcgatatgaaattctcatactgtgacgaaaggataacagagctaatgggatacgagcccgaagagcttctcggtcggtcaatttatgagtattatcatgctctcgactcagatcatcttactaagacccatcacgacatgtttaccaaaggacaagtcactacgggccagtataggatgctcgctaagcgcgggggctatgtttgggtggaaacacaagccactgtgatctataacaccaaaaatagccagccccagtgtatcgtgtgtgtgaactacgttgtatccggcatcattcagcatgacctgatcttcagcctacagcagacagagtgtgtcctgaaacctgtagagtcgagtgatatgaagatgacacagctatttaccaaggtcgaaagcgaggatacttcatctctgtttgacaagctgaagaaggagccagatgcacttacgctgctggcccctgccgcgggcgatactattatctcactggattttgggtccaatgatactgaaacagatgaccagcaacttgaagaagtccctctgtacaacgacgtcatgcttccaagcccgaacgaaaagctccagaacattaacctcgccatgtctccccttccaaccgccgaaacgcctaaacctctccgatcttctgctgatcccgcccttaaccaggaggtcgctctgaaactggagccaaaccctgagagtctcgaactgtcttttaccatgccgcaaatacaagatcaaacaccttccccctctgacggtagcacaaggcagtcttccccggagcctaattcaccttctgaatattgcttctatgtggactctgatatggtgaacgaattcaaacttgagctcgttgagaagctgtttgcagaagatactgaggctaagaatcccttctccacacaggatacagacttggacctcgagatgctggcaccatacatccctatggacgatgacttccagctccgctcttttgatcagctcagcccactcgaatcttcatccgcgtctccagaatcagccagccctcagtcaactgtaacagtctttcagcagacccagatccaggagccaacagcaaatgcaacgactaccacagcaactactgacgagttaaaaaccgtgacaaaagatagaatggaggatattaagatcctcatcgcatctccatctcccacccacatccacaaggagaccacctccgccacaagctccccttatcgcgacacccagtctcggaccgcaagccccaaccgagctggaaagggcgtgatagaacagactgaaaaaagccacccaagatccccaaacgtcctgagcgtcgctctcagtcagaggacaacagtgccagaagaagaactcaacccaaagattctggccctgcaaaatgcccagcgcaaacggaagatggagcatgatggatcattattccaggctgtgggaattggcactctgttgcagcagcccgatgaccatgctgccaccacctctctgagctggaagcgggtaaagggctgtaagtcctctgagcagaacggcatggagcaaaagaccatcatccttatcccttctgatcttgcatgccggctcctgggccaatccatggatgagtccggcctaccccagctcacctcttatgactgtgaggtgaacgcaccgatccagggtagtcggaacctcctgcaaggagaggagctgctcagagccctggaccaagtgaat

SEQ ID NO: 33091 - DNA, 2478 bp, Artificial Sequence
  Description of Artificial Sequence: Synthetic coding sequence
atggaaggcgctgggggcgccaacgataagaagaagatctcaagtgagcgccgtaaagagaagagcagggacgcagcccggtcaaggcggagcaaagagtccgaagtgttttatgagctggcccatcagcttcctctgccccacaatgtgtcatcacatctggacaaagcaagcgtcatgcggttaactatctcctatcttcgggtgcgcaagcttttagatgcgggcgatctggatatcgaggatgacatgaaagcccaaatgaattgcttctatctcaaggccttagacgggtttgtgatggtactgactgatgacggcgatatgatctacataagcgataatgtcaacaaatatatgggcttaactcagtttgagctgactggccattctgtgttcgacttcacccatccgtgtgaccacgaagaaatgagggagatgttgacgcacagaaacggccttgtgaagaaaggcaaggagcaaaacactcaacgttccttctttctccggatgaaatgcactttaacttcaagaggtcgaacgatgaatattaaatccgcaacctggaaggtactccattgcactggacacatccatgtctatgacaccaacagtaatcaaccgcagtgtgggtacaagaagccccccatgacctgcttagttctgatttgcgaacccattccacatcctagtaacatagaaatcccattggacagcaagacttttcttagccgccacagtctggacatgaaatttagctattgcgatgagagaattacagagctgatgggatacgagcccgaggaattactgggcaggtccatatatgaatactatcacgccctggactctgaccacctgactaaaacgcaccatgacatgttcacaaagggccaagtaacaaccggccagtatcgcatgctggcgaaacgcggcggttatgtttgggtggagactcaggccacggtgatatataatactaagaactcccagccccagtgcatagtgtgcgttaactatgtggtgtctggcattatacaacatgacctgatcttctcactgcagcagacggagtgtgtattgaaacccgttgaaagctcagacatgaaaatgactcagctgtttaccaaagtggaatcagaggacactagctctctgttcgacaagctcaagaaagaacctgacgccctgacgcttctggctcctgccgctggagatacaatcatctctttagattttggtagtaacgataccgaaacagacgaccagcagctcgaagaggtaccactgtataatgatgtcatgttgccttcccccaacgaaaaactgcaaaatattaacctagcgatgagcccattgccaaccgctgaaacccccaaacctttacggtcttccgccgatcctgcactcaatcaggaggttgcgctgaagctcgaacccaatcccgagtccctcgagctgagctttaccatgccgcagattcaggatcagacaccaagtccttctgacgggtcaacccgtcagtcgtcaccggagccaaattcaccttcggagtattgtttttacgtggactcggatatggtcaatgagttcaagttggaactggtggagaagttgttcgctgaggatacagaagcaaagaatcccttttcgactcaggataccgatcttgatctggagatgttagctccatatattccgatggatgatgacttccaattgcgctcatttgatcaactgtctccactggagtcctcctctgcttcccctgagtccgcatcccctcaatctactgtcaccgtatttcagcagacacagattcaagagccaacggctaacgctactactacaacagctacaacagacgaattgaagaccgtgaccaaggaccgaatggaggacattaagattctcatcgcatcccccagccccacacatatccacaaggagacaacatccgctacatcatctccatatcgggatacacagtctcgcaccgcatcacctaatagagccggcaagggggtgattgaacaaaccgagaagagccatccgcgaagtccgaacgtgctcagtgtagctctttctcagaggaccacagtgcccgaggaagaactgaatcccaaaattttggccctccaaaatgcacagcgtaagcgcaagatggaacacgacggatctcttttccaggccgttggcataggcaccctgctgcagcagcccgacgaccatgctgccaccacttctctaagttggaagagggttaagggatgcaagagcagtgagcagaacggcatggagcaaaagacgataatcttaataccatcagatttagcctgccgccttcttggccagtctatggacgaatctggactgccccagctgacctcctacgattgtgaggtgaatgctcctatccagggcagcaggaacctgctgcagggcgaagagctcctgagggcccttgaccaggtgaat

SEQ ID NO: 33092 - DNA, 2478 bp, Artificial Sequence
  Description of Artificial Sequence: Synthetic coding sequence
atggaaggagcaggaggagcgaatgataagaagaagatttccagcgagcgtaggaaggaaaagtcccgtgacgcagcacgctcccgtcgttccaaggagtcggaggtgttctacgagcttgcgcatcaactcccccttccacataatgtgtccagccatctggataaggctagcgtcatgcggctcactatctcgtaccttagggtgaggaagctgctggatgcgggtgacctggatatagaagatgatatgaaggcccagatgaattgtttctacctcaaggcccttgacggtttcgtgatggtgctcactgatgatggtgatatgatctatatcagtgataatgtcaacaagtacatgggcctgacccagtttgagcttaccggccactccgtgtttgattttacccatccatgtgaccacgaagagatgcgggagatgcttacccatagaaacgggctggtcaaaaagggcaaggagcagaacacccagcggagcttttttctgaggatgaagtgcaccctgaccagccgaggtcggactatgaacattaagtcggcaacttggaaggtgcttcattgtactgggcatattcacgtgtacgacaccaactccaatcagccacaatgcggatacaagaagccaccaatgacgtgcctggtgcttatttgtgaacctattccgcatccgtcaaatatcgaaatccctttggatagcaagacttttctctcgcgccattcccttgacatgaagttctcgtactgtgatgaacgtattaccgaactgatgggatacgaacctgaagaactgttgggacggtccatatacgaatactaccacgctctggactcggatcatctgaccaagacccaccatgatatgtttaccaagggtcaggtcaccacggggcaataccgcatgctggcaaagagaggtggctacgtctgggtggaaactcaggccacggtgatttacaacactaagaactcacagccacagtgtatcgtttgtgtcaactacgtggtgtcagggattatacagcatgatctgatcttttccttgcagcagactgaatgtgtccttaagcctgtggaatcgagcgacatgaaaatgactcaactctttactaaagtcgaatcggaggacacgagcagcctctttgataagctgaagaaagaacctgatgccctcactctgctcgcaccagccgcaggggacactatcatttcgctggacttcggctccaacgacaccgaaaccgacgatcaacagctggaggaagtccccctctacaatgatgtgatgcttccatcgcctaatgaaaagctccaaaacatcaacctggccatgtcgcctcttcctactgcagaaactccgaagcctctgcgatcatcggcagatccagcactgaatcaggaggtggcccttaaactcgagcctaaccctgagtcactcgagctctcctttactatgcctcaaatacaggatcagaccccctctccatccgatgggagcactagacagtcgtcccctgaaccaaacagcccttcggaatattgcttttacgtggattcagatatggtcaacgagttcaagctggagctcgtggaaaagctgtttgcagaggacactgaagcaaagaaccccttttcgactcaggatactgatcttgatcttgagatgttggcaccatacattccgatggacgatgatttccagttgaggagctttgaccagctttcgccccttgagtcatcgtccgcatcgcctgagagcgcctcgcctcaatccacggtcaccgtctttcagcaaactcaaattcaggaaccaacggccaacgcaactactaccaccgcaaccacggacgaactgaaaaccgtgactaaagatcgcatggaagatatcaagattctcatagcatcaccatcgccaactcacattcacaaagaaactacctccgcgacgtcatccccctatagagatacgcaatcccgcactgcgtcacctaaccgtgcaggaaaaggagtcatcgaacagactgaaaagtcacatcctaggtcgcctaacgttcttagcgtcgccctgtcacaaagaaccaccgtgcccgaagaggagctcaaccccaagatcctcgctctgcaaaacgcacagagaaagcggaaaatggaacacgatggatcgctgtttcaagcagtgggaattggtactctgcttcaacagcctgacgatcacgcagcaaccacgtccctttcttggaagcgtgtgaagggctgcaagtcctcggagcaaaacggaatggaacaaaagacgattattctgattccctccgatctggcatgcagactgctggggcaatccatggacgaatcgggactgccacaactgacgtcctacgattgtgaggtgaatgctccaatccaaggatcacgcaatctccttcagggtgaagagcttctgagagcgcttgatcaggtcaac

SEQ ID NO: 33093 - DNA, 2478 bp, Artificial Sequence
  Description of Artificial Sequence: Synthetic coding sequence
atggaaggcgcaggtggagctaacgataagaaaaagatcagctccgagagaagaaaggaaaagagccgggatgccgcccggagccgccggagcaaggaatccgaggtgttctacgaactggctcatcaattgcctctgcctcacaacgtgtcctctcaccttgataaggcttcggtgatgagactgactatctcctacctgagagtcagaaagctccttgacgctggtgatctggatatcgaagatgacatgaaagcccagatgaactgtttctacctcaaggccctcgacgggttcgtaatggtgttgaccgatgacggagacatgatctacatcagcgacaacgtgaacaagtacatgggcctcactcagtttgaactgaccggccactcggtgttcgacttcactcatccatgtgatcatgaagagatgagagaaatgctgactcatcgtaatggcctcgtgaaaaaggggaaggagcagaacactcagcggtcgtttttcctgcgcatgaaatgcactcttacctcgagagggcggaccatgaacattaagtcggccacttggaaggtgctccactgcactgggcacatccatgtgtatgacactaactcaaatcagccgcagtgcgggtacaaaaagccgccaatgacctgtctggtcctcatctgcgagccaatcccgcaccctagcaacatcgagatcccattggactcgaaaacttttctgtcccgccactcactggacatgaagttctcgtattgcgatgaacggattactgaacttatgggatacgagcctgaggagctcctgggaagatcgatctacgaatactaccacgccctggatagcgaccacctcactaagacccaccatgacatgttcaccaagggccaagtgactaccggacaatacaggatgcttgcgaagcgcggaggatacgtctgggtcgaaactcaggccactgtgatatacaataccaagaactcgcaaccccaatgcatagtctgcgtgaactacgtggtttcagggatcattcagcacgatctgatcttctccctccagcagaccgaatgcgtccttaagcccgttgaatcgtcggacatgaagatgacccaactgttcactaaggtcgagtcggaggacacctccagccttttcgataaacttaagaaagaaccagatgctctcactcttttggcaccggctgccggggatactatcatcagcctcgacttcggaagcaatgataccgagactgatgatcagcagcttgaagaagtgccactgtacaacgatgtgatgttgccctcaccaaatgagaaactgcagaatatcaatctggccatgtctccactccctactgctgagactcctaagccgctgcgctcaagcgccgatcctgccctcaatcaggaggtcgcccttaagctcgaaccgaacccggaaagcctcgagctgtccttcaccatgccacagatccaagaccagaccccgtccccgtctgacggatccactcgccagtcatcgccggagccaaattcgccttcggagtattgtttctacgtggactccgatatggtcaacgagttcaaacttgagctggtggagaagctgttcgcggaagataccgaagctaagaatccctttagcacccaggacaccgacctggacctggaaatgctcgcaccgtacatcccaatggatgatgattttcaactccggagcttcgatcaattgtcaccgctggaatcttcatccgcctcgcccgaatccgcgtcacctcagtccaccgtcacggtgttccaacaaacccaaatccaagaaccgactgcgaatgccactaccaccaccgcgactaccgatgaacttaagaccgtgactaaggacagaatggaagatatcaaaatcctgatcgcctcgccatcacccacccacatccacaaagagactacttccgccacttcatcgccctaccgggatacccagtcaaggacggcgtcaccgaacagagccggcaagggagtgatcgagcaaaccgaaaaatcccatccccggtcgcccaatgtgctgtcggtggctctgtcgcaaaggaccaccgttccagaggaggaactcaacccgaagatcctggcacttcagaatgcgcaacggaaacgcaagatggaacatgacggttccctgtttcaggcggtcggcattggcacgctcctgcagcagccggacgaccatgcagcgaccaccagcctctcctggaagcgggtgaagggatgcaagtcaagcgaacagaatggaatggaacagaaaaccatcatcctcattccgagcgacttggcctgccggctgctgggccaatcaatggacgagtccggcctgccacaattgacttcgtacgactgtgaagtgaacgcaccaatccagggcagccgcaacctcctccagggggaagagctgctgcgggcattggaccaggtgaat

SEQ ID NO: 33094 - DNA, 2478 bp, Artificial Sequence
  Description of Artificial Sequence: Synthetic coding sequence
atggaaggagctggaggagcaaacgacaaaaagaagatttcctccgagcggagaaaagagaagagcagagatgcggcacgtagccggcggtccaaagaatctgaagtcttttacgaattggcgcatcaactcccattgccgcataatgtgtcaagccacctggataaggcatcggtcatgcgtcttactatctcttaccttcgggtcaggaaacttctcgatgcaggagatctcgacatcgaagatgacatgaaggctcagatgaactgcttctacctgaaggcactcgacggatttgtgatggttttgacggatgatggtgacatgatctacatcagcgataacgtcaacaagtacatgggccttactcagtttgaactgaccggccatagcgtctttgattttacccacccatgtgaccatgaagaaatgcgggagatgctgacgcaccggaatggactggtgaagaagggtaaggagcaaaacactcagaggtcctttttcctgagaatgaagtgcaccctgacctcgagaggtcggactatgaacattaagtccgcaacctggaaggtccttcattgtaccggtcatatccacgtgtacgacactaactccaatcaacctcagtgtggttacaagaagcccccaatgacttgccttgtgctgatttgtgagccaattccccatccctcaaacattgagatcccattggacagcaagacttttctgtcccgtcactctctggacatgaagttttcctactgcgacgagcgaattactgagcttatgggatatgagcctgaagaacttcttgggagatcaatttacgaatactaccacgctctcgattcggaccatctgaccaagactcatcacgatatgtttactaagggacaggtcaccaccggtcagtaccgtatgttggcaaaacgaggaggttacgtatgggtggaaacgcaagcaaccgtgatttacaacaccaaaaactcccaacctcaatgcatagtctgtgtcaattatgtggtgtccggcatcatccagcacgatcttatcttcagcctccagcagaccgagtgcgtgctcaagccagtggaaagcagcgacatgaagatgactcagctttttactaaggtggaatcggaggacacttcgtcgctgtttgataagctgaagaaagaaccggatgctctgactctgcttgccccagcagcaggtgacaccatcatttcgctcgactttggctcgaatgataccgaaactgatgatcagcagctggaagaagtgcccctttacaacgacgtgatgctgccctcccctaacgaaaaacttcagaacattaacctggcgatgtccccactgccaaccgctgaaacccctaagcctttgagatcgtcggcagatccggccctgaatcaagaagtcgcgctcaaactcgaaccaaatccggaatccctcgagctgtcgttcactatgcctcagatacaggaccagactccttcaccatccgatggatccaccagacaatcctcaccagaacccaactcgcctagcgaatactgtttttacgtggattcagatatggtcaacgaattcaaattggaactggtggaaaagctgtttgcggaggataccgaagcaaagaatccattcagcacgcaagatactgatcttgacttggagatgctggcgccctacattcctatggacgacgattttcaactgcggagctttgatcaactttcccctcttgaatcgtcgagcgcatcgcctgaatccgcatcgcctcagtcaactgtcaccgtgttccaacagacccaaattcaagaacctactgcgaacgcaaccaccaccacggctactactgatgagctgaaaactgtgactaaggacagaatggaggacattaagattcttattgccagtccttccccaacgcatattcataaggaaactacttcagcaacttcgtcgccttaccgcgatacccaatcacggaccgcgagcccaaatcgcgccggtaagggtgtgatcgaacaaaccgagaaatcgcatcctcgttcgccaaatgtgctgtccgtcgcactgtcgcagagaaccactgtgcccgaggaagaactgaacccaaagatcctggcattgcaaaacgcccaaaggaagagaaaaatggaacatgatggctcactttttcaggctgtgggtattggcacgctcttgcaacaacctgacgatcacgcggcaaccacgtcactctcgtggaagcgtgttaaagggtgcaagagctccgaacagaacggcatggagcaaaagaccattattctcattccgtctgatctggcttgtcggcttctgggtcaaagcatggacgaatcgggcctgccacaactgacctcatatgattgtgaagtgaatgctccaatacaaggctcacggaacctgctgcaaggtgaggaacttcttcgcgcccttgatcaggtgaac

SEQ ID NO: 33095 - DNA, 2478 bp, Artificial Sequence
  Description of Artificial Sequence: Synthetic coding sequence
atggaaggcgctgggggcgcaaacgataaaaagaagatttcttcagagcgccgaaaagagaagtcccgggatgcagcacggtctagacgctcgaaggagtctgaagttttttacgagctcgcccatcagctgcctctgccacacaacgtgtccagccaccttgataaggcctctgttatgcggttaacaatctcatatctgagggtccgaaaactgctcgatgcaggggaccttgacatagaagacgatatgaaggcgcagatgaattgtttttatctcaaagctctggacggatttgtgatggttctgactgacgacggagacatgatctatataagtgataatgtcaacaaatacatggggttgactcagttcgagctgacgggccactctgtattcgacttcacccacccctgcgatcatgaggagatgagagagatgctcacacacagaaatggactggtgaaaaagggcaaggagcagaatacccagcgctctttctttctgagaatgaaatgtactcttacctcgcgcgggagaacaatgaacatcaagtcagctacttggaaagtgctacactgcaccggccatattcacgtgtacgacacaaactctaaccaaccccagtgtggttacaagaaaccccccatgacttgtctggtcctgatatgcgagcccatccctcatccaagtaacatcgagatcccattggactctaagaccttcttgtctagacactcactcgatatgaagttctcctattgtgatgaacgaatcacagaactcatgggatatgagccggaagagctgttagggaggtccatttacgagtattaccatgccctggattccgaccaccttaccaagacacatcacgatatgttcaccaaggggcaggtgaccacaggccaatacagaatgctggcgaaacgaggcgggtacgtttgggttgaaacccaagccacagttatctataacaccaagaactctcagcctcagtgcatcgtgtgcgttaattatgtcgtgtccgggatcatacagcacgatctgatttttagtctgcagcagaccgaatgtgttctgaaaccggtggagagctccgatatgaagatgactcaactattcaccaaggttgagagcgaagatacttcatccctgtttgacaagttgaagaaagagcccgacgcgttgaccctgctggctcccgccgcaggcgatacaatcatctcattggactttggctccaacgacacagaaacagatgaccagcagctggaagaagtgcctttgtacaatgatgtcatgctgccatcacctaacgagaagctgcagaacattaaccttgctatgagtccactgcctactgctgagactcctaagccgctgcgctctagcgctgaccccgccctcaatcaagaggtggctctgaagctcgaaccaaatccagaaagcttggagctgtcttttacgatgccccaaatccaggatcagacccctagccccagcgacggcagcactcggcagagcagtcccgagcctaacagcccctccgagtactgcttttacgttgatagcgacatggtgaacgaatttaaactggagctggttgagaagctcttcgcagaagacacggaagcgaaaaaccctttctcaacccaagacactgacctggatctggagatgcttgccccttacatcccaatggacgacgactttcagctacggtcctttgatcagctgtctccacttgagagttccagcgctagtccagaatcagcctcaccccaatcaacagtgactgtgttccagcagacccagatccaggaacctacggccaatgcaaccactaccactgcaaccacagatgaactcaagaccgtgacaaaggatagaatggaagacattaagattctcattgcctccccatcgcccacgcacatacataaagagacaacgtcggcaacgtctagtccctaccgtgatactcaatctcgcactgcctctccaaaccgcgcagggaagggggtgatcgaacagactgagaaatctcacccacgctcgcctaatgttctgagcgtagccctgagtcagaggaccaccgtgcctgaggaggaattaaatcctaaaatccttgctctccagaacgctcagaggaaacgaaaaatggaacatgatggctccttgttccaggctgtcggaataggaactcttcttcagcagccagacgaccacgccgctaccacttctctatcctggaagcgggtcaagggctgtaagtcgtccgagcagaatgggatggaacagaagaccatcatcctcatcccatctgaccttgcctgccgattgcttggtcagtccatggatgagtccggtcttcctcagctgacaagctacgactgtgaggtcaatgccccaatccagggctcacgtaacctcctgcagggagaagagctactcagagcacttgaccaggtcaac

SEQ ID NO: 33096 - DNA, 2478 bp, Artificial Sequence
  Description of Artificial Sequence: Synthetic coding sequence
atggaaggagcgggaggggcaaacgataaaaagaagatatcatcggagcggcgaaaggaaaagtcccgtgatgcagcacgatctcgccgctctaaggagagtgaagttttctacgaactcgcacatcagctgccgctgccgcacaatgtatcctcccacctggataaagccagcgtcatgagactcacaattagttacctgagagtccggaaactgcttgatgcgggggacctggacatcgaagacgatatgaaggcccagatgaattgcttttacctaaaagccttggatggcttcgtgatggtactgacagatgatggtgatatgatctacatcagcgataatgtgaacaaatacatgggcctcacgcagtttgaattgactggccacagtgtgtttgacttcacccatccttgtgaccacgaggaaatgcgagagatgctcacacatagaaatggactggtcaagaaaggaaaggagcagaacacccagcgctctttctttctgcgcatgaagtgcaccctgacaagtaggggccgcaccatgaatattaaatctgcgacctggaaggtcctgcattgcacaggccatattcacgtgtacgacaccaattcaaatcagccccagtgcgggtataagaagccaccgatgacatgtctcgtgttaatctgcgaacccatcccccacccaagtaatatcgaaattcccctcgatagtaaaactttcctcagtagacattcacttgatatgaagttcagctactgtgatgaacggatcaccgagctcatgggttatgagcctgaggagcttcttgggcggtctatttatgagtactatcatgccctggatagtgatcacttgacaaagactcaccatgacatgtttaccaagggacaagtaacaacaggccagtaccgcatgctagcaaagagaggggggtacgtgtgggttgagacccaggccacagtcatctataatacaaagaacagccaaccccagtgcatagtatgtgtgaattatgtagtaagtggaatcattcaacacgacctgatcttttcactgcaacagactgagtgcgtcctcaagcccgtagagagctccgacatgaagatgacgcagttgttcacgaaagtggaatcagaggatactagctcgctcttcgacaaattgaagaaggagcctgatgcccttacccttctggcccctgccgccggcgacacaattatttcattggatttcgggtctaacgataccgaaacagatgaccagcagctcgaggaagtgccactctacaacgacgtgatgctgccgtccccaaatgagaagctccagaatatcaatctggctatgagcccattgcccaccgccgaaacccccaaacctctccgcagctctgccgacccggccttgaaccaagaggttgccttaaaattagaacctaatcccgaatccttggagcttagcttcaccatgccccagattcaggaccaaaccccctctccgtctgacggcagcacaaggcagtcctcacctgagcccaattctccatcagaatattgcttttatgtggattccgacatggttaatgaattcaaattagaactggtggagaaactgtttgcagaagacacagaagctaagaaccctttttccacccaggacacagacctagatcttgagatgctggcgccttatatcccgatggacgatgacttccagctaaggtccttcgatcagctgagtcctctggaaagttcctctgcctcccccgaatccgcctcaccccagtcaaccgtcactgtgttccagcagactcagatccaggagccaacagccaacgctacaacaacgaccgctacaaccgacgagctgaaaacggtgacaaaggacaggatggaagacatcaagatactcattgcctccccaagcccgacgcatattcacaaggagactactagcgccacgtcaagtccctaccgcgacacccaatcaagaacggctagcccaaatagggcaggtaaaggggttatagagcaaacggaaaagagccatccacgctcccctaatgtgttgagcgtcgcgttaagtcagaggactaccgtcccggaggaggaactcaatcctaagatcctggccctgcaaaacgctcagaggaaacgaaaaatggagcacgacggctcactgttccaggcagtcggcataggtactctcctgcaacagccggacgaccatgccgctactacctccctgtcatggaagcgggtaaaggggtgcaagtcgtctgagcagaacggcatggaacagaagactatcattctgattccatctgacttggcctgcaggctgcttggccagagtatggacgaaagtggcttgccacaactcacatcctacgattgtgaagtcaacgcgccgatccagggatcccgcaatttgttacaaggggaagagctgctgagggctttggatcaggttaac

SEQ ID NO: 33097 - DNA, 2478 bp, Artificial Sequence
  Description of Artificial Sequence: Synthetic coding sequence
atggagggcgccggtggtgcgaatgacaaaaagaagatttcctccgagaggaggaaggagaagtcaagggatgcagcccggtcccggcgctcgaaagagagcgaagtgttctacgaactggcccaccaactgcccctcccgcataatgtgagctcccacctcgataaggcctctgtcatgcgcctgactatctcgtacttgcgcgtccggaagctgctggacgcaggggacctcgacatcgaggatgatatgaaggcgcaaatgaactgtttctacctgaaggctctggacggtttcgtgatggtcttgactgacgacggtgatatgatctacatcagcgataacgtgaacaaatacatgggactgactcagttcgaattgaccgggcactccgtgtttgatttcacccacccatgtgaccatgaagaaatgcgggagatgctgacgcaccggaatggactggtcaaaaagggaaaggagcagaacactcagagatcattctttctgaggatgaaatgcacgctgacctcccgcggtcgcactatgaacatcaagtcggcgacctggaaggtgctccattgcaccgggcatatccacgtgtacgatactaatagcaaccagcctcagtgcgggtataagaaaccgccaatgacttgtctggtgctcatttgtgagcctatcccgcatccttccaatatcgaaatccccctggactccaaaacctttctctcgcggcactcgctcgacatgaagttctcgtactgcgatgaaagaatcacggaacttatgggatatgaacccgaagagctgctggggcgctcgatttacgaatactaccacgccctcgactccgatcatctgaccaagacccaccatgacatgttcaccaaggggcaggtgaccactggacagtatcgcatgctggcgaaacggggaggctacgtatgggtggaaacccaagcaaccgtcatttacaatactaagaatagccagccccagtgcatcgtgtgcgtgaattacgtcgtgtcgggaatcatccaacatgacctgatcttctctctgcagcaaaccgagtgcgtcctcaagcctgtggaatcctccgacatgaagatgacgcaactcttcactaaggtcgaatcggaggacacctcgtcattgttcgataaactcaagaaagagcctgacgccctcacgctgctcgctccggccgctggcgacaccatcatttcgctggactttggctccaacgacaccgaaaccgacgaccagcaactggaagaagtcccgctgtacaacgatgtgatgctcccaagccctaacgaaaagctccagaacatcaatctcgccatgtccccgctgcctactgccgaaactcccaagcctttgcgctcgtcggcggaccctgccctgaaccaggaggtggcgctgaagctggagccgaacccagaatcattggaactgtccttcaccatgccgcagattcaagatcaaactccatccccctccgacggatccacccggcagagctcgccagagccgaacagcccttcagagtactgcttctacgtcgactcggatatggtgaatgaattcaaactggaactggtcgagaaactgttcgcggaggacacggaagccaagaatccgttctccacccaagacactgatcttgacctggagatgctggcaccttacatcccgatggacgacgacttccagctgagatcatttgaccagttgtcaccgctggagtcgtcgtcagcatccccggaatcagctagcccgcagtcgaccgtcactgtgttccagcagacccagatccaagagccgactgcgaacgcaactaccacgactgctaccactgacgaattgaaaaccgtgaccaaggacagaatggaggacatcaagatcctcatcgcctcgccgtccccgacccacatccacaaagaaaccacgtccgccacttcctcaccctaccgggacacccagagccgcacggcatccccgaacagggccggtaaaggggtgattgagcagaccgaaaagtcccacccgcgctccccgaatgtgctgagcgtcgcactgtcccaaaggaccactgtgccagaagaagagctcaacccaaagatacttgccctgcagaatgcgcagcgcaagagaaaaatggaacacgacggctcattgttccaggccgtgggaatcggaacgctgctgcagcaaccggacgaccatgcagccaccacgtcgctgtcctggaagagagtgaaggggtgcaagagctctgaacaaaacggcatggagcaaaagacgatcatcctcatcccgtccgacctcgcatgcaggctgctcggccaaagcatggacgaatccggacttccgcaactcactagctacgattgcgaggtgaatgctccgatccaaggatccaggaacctgctgcaaggtgaagaattgctgcgcgctctggatcaagtgaac

SEQ ID NO: 33098 - DNA, 2478 bp, Artificial Sequence
  Description of Artificial Sequence: Synthetic coding sequence
atggaaggcgcaggtggggctaatgataaaaaaaaaatttcttctgaaagaaggaaggaaaagtctcgtgatgcagcccgtagccgacggagcaaggaatctgaagtgttctatgagttggctcatcaacttccccttccccataatgtaagctcccacttagacaaggctagcgttatgaggttgaccattagctatcttagagtgcgtaagttgttggatgctggcgaccttgacatcgaggacgacatgaaggctcagatgaattgcttttatttgaaggctttagatggctttgtgatggttcttactgatgatggggatatgatttacataagcgacaacgttaataagtacatgggccttacacaattcgaacttactggccattcagtcttcgatttcactcacccttgcgatcatgaggagatgcgtgaaatgcttacccatagaaatggactggttaagaaggggaaagagcagaatactcaaaggtccttctttttgaggatgaagtgcactttgacatctagggggagaactatgaacatcaaatctgctacttggaaggttctccactgcaccgggcacatccatgtgtatgataccaactccaaccaaccccagtgtggttataaaaaaccccccatgacatgcttggtcctcatttgtgagcctatacctcacccctcaaatatcgaaattccactagattcaaagactttcctctctcggcattctttggatatgaagttttcttactgtgacgaaagaattacagagttgatgggctatgagccagaggaacttcttggaaggtctatttatgagtattatcatgctctagactccgatcatctcacgaaaacccatcacgatatgttcactaaggggcaggtcacaaccggtcaatataggatgctcgctaagaggggtggatacgtgtgggtagagacacaagctacagttatctataataccaagaatagccaaccacaatgtatcgtatgtgtgaattacgtggtatccggaattatacagcatgaccttatattctcacttcaacaaacggaatgcgttttgaaacccgtggaatcgagtgacatgaagatgactcaacttttcaccaaagtagaatccgaagatacttctagcttgttcgataagcttaagaaggagcctgatgcattgaccctgctggctcctgcagccggggatacaatcattagccttgatttcggtagcaacgataccgaaacagacgaccaacaactcgaggaggtgccgttgtacaatgatgtgatgctgccttcgccgaacgagaagcttcagaacattaacctggcaatgtctcctttgcctaccgctgagacaccaaagcctcttagaagtagcgccgatcctgccctgaaccaagaagtagctcttaaacttgaacccaaccccgaatctttagagcttagcttcaccatgccgcagatccaagatcagaccccttctccttctgatggatctactaggcaaagctcgcctgaaccaaattctccatcagaatattgtttttacgttgattcagatatggtgaatgagttcaagctagagcttgttgaaaaactcttcgccgaagataccgaagctaagaacccgttttcaacccaagatacagatcttgacctggaaatgctcgccccttacatacctatggatgacgatttccagctcagaagtttcgatcaactctcaccactcgaaagctcgtctgcttcgccagaatcggcatctcctcagtcaactgttactgtctttcaacaaacacaaattcaagaaccgactgccaacgccactacgacaactgccaccacggatgaattaaagacagttacaaaggaccgcatggaagatattaagatcttgatagctagcccatcgcctactcacattcataaggaaactacctccgcaacttcttccccgtaccgtgatacacaaagtaggacagcatcgcctaatcgtgccggtaaaggagtgatagaacagactgaaaagtcacacccccgctctcccaacgttctctccgttgctttatcgcaacggactaccgtgcctgaagaagaactgaatccgaagatactcgctttgcaaaatgcccagcgaaagcggaaaatggagcatgatggtagcctgttccaagcagttggtattggaactcttctgcagcaacctgacgatcatgcagcaactaccagtctctcgtggaaaagggtaaagggttgcaagtcttctgaacaaaacgggatggaacaaaagacgattattttgatcccgtcggatttggcttgtaggctattaggtcagtcaatggatgaatctggcctgcctcagctcacctcttacgattgcgaagttaacgcacctattcaggggtcacgcaatttgcttcaaggagaagaactcttgagagcacttgatcaggttaat

SEQ ID NO: 33099 - DNA, 2478 bp, Artificial Sequence
  Description of Artificial Sequence: Synthetic coding sequence
atggagggtgctggcggagccaacgacaaaaagaaaatctccagcgagcgacgcaaagaaaaatcacgggatgccgcacgctcacgccggtcaaaggagagtgaggtcttctacgagcttgcgcatcaattaccacttccccataacgtgtccagccacttggataaagcctccgtcatgcggctgaccatttcctacctgcgggttaggaagctgcttgacgctggagaccttgatatcgaggatgacatgaaggcgcagatgaactgcttctacctcaaggccttggacggctttgtaatggtactcaccgatgatggcgacatgatttatatctccgataatgtgaataagtatatgggtctcacccaatttgagctaaccgggcactcagtattcgacttcacgcatccttgcgaccacgaggaaatgagggagatgctgacgcatcggaacggcctggtgaagaaggggaaggagcagaatacacagaggtcatttttcctccggatgaagtgtacactgacttccagaggcaggaccatgaacattaaaagcgcgacctggaaggtgctccactgtaccggacacatccacgtctacgacactaattcaaatcagcctcagtgcgggtacaaaaaacccccaatgacctgtctcgttctgatatgtgagccgatcccccatccctccaatattgagatccccttagattcaaagactttcctgagcaggcacagtttggatatgaaattctcttattgtgacgaacggatcactgagctcatgggctacgagccagaggagttactcgggcggagtatatacgaatactatcacgctctggacagcgaccacctgacaaaaactcatcatgatatgttcactaagggccaggtcacgaccgggcagtacaggatgctggccaagagagggggctacgtttgggttgagacccaagcgacagtgatctacaacactaagaatagccagcctcagtgcattgtttgcgtgaattatgtggtatctgggattatccagcacgatctgatcttctccctgcaacaaacagagtgcgttctgaagcctgtggagagcagtgatatgaaaatgactcagctgtttactaaggtggagagtgaggatacgtcatccctttttgataagctgaaaaaggagccggacgctctgacgctcctcgcaccagccgccggggacacaatcatctcgcttgatttcggaagcaatgatactgagaccgacgatcagcagttggaggaggttcccttgtataacgatgtgatgctgcccagccctaacgagaaactccagaatatcaatctcgccatgagtccacttcctacagccgaaaccccgaagcctttaaggtctagtgcagatccagcgctcaaccaggaggtagccctgaaactcgagcctaatccagaaagcttggagctgagcttcacaatgcctcagatccaagaccagaccccaagcccatccgacggctccacaagacagtctagtccagaaccaaattctccttccgagtattgtttttatgttgactcagatatggttaacgagttcaagttagagctggttgaaaagctgttcgccgaggacaccgaggccaagaaccccttcagcactcaggatacggacttggatctcgagatgctggcgccctatattcccatggatgatgatttccagctgagaagcttcgatcagctttctcccctggaaagctcctctgcgagtccagaatcagcatctccccaaagcacggtgaccgtcttccaacagacccagatccaggagcccacagccaatgccacaacaactactgcaacaacggacgagctcaaaacggtcaccaaggaccggatggaagatatcaagattctgatcgccagccccagtccaacccacattcacaaagagacaacctctgccacctctagcccgtacagggacactcagagcaggacagcctcacctaatagggcagggaaaggcgtcatcgagcagacagagaagtctcatccccgctctcccaatgtcctctcggtggctctctcccagcgcactaccgtgcctgaggaagagctcaatcctaagatcctggctttgcagaacgcacagcgaaagaggaagatggagcacgatggcagtcttttccaggccgtaggtattggcacactcctgcagcagcccgacgatcacgccgccactacctcactcagctggaagcgcgttaaagggtgtaagtccagtgaacaaaacggaatggagcaaaagaccataattcttataccctcagacctggcatgccgtttactgggccagtcaatggatgagagcggcctcccacagctcacctcctacgattgcgaagtgaatgcgccaatccagggatcgaggaatctgctgcagggcgaagaactgctgcgggccctggatcaggtgaat

SEQ ID NO: 33100 - DNA, 2478 bp, Artificial Sequence
  Description of Artificial Sequence: Synthetic coding sequence
atggaaggcgcaggtggagccaacgacaaaaagaagatctcctcggagagacgcaaagaaaagagcagagacgcggcaagaagccgacgatcgaaggaatccgaggtcttttacgagctcgcgcatcagcttcctttgccccataacgtgagctcccatctggataaggcctcggtcatgcgactgaccatttcgtaccttcgtgtcagaaaacttctggatgcgggcgatctggacattgaagatgacatgaaagcccaaatgaattgtttttaccttaaggcgctggatggtttcgtgatggtcctcactgatgacggagacatgatctatatctcagataatgtgaacaaatacatgggattgacgcagtttgaactgaccgggcatagcgtgttcgatttcactcatccatgcgatcatgaggagatgcgggagatgctcacccaccgcaacggactggtgaagaagggaaaggaacagaacacccaacggagcttctttcttaggatgaaatgtactcttacttcaagaggccggaccatgaacattaagtcagcaacctggaaggtgctgcattgcaccggacatatccatgtgtacgatacgaactcgaaccagcctcaatgtggttataagaaacctccaatgacctgcctggtcctgatttgcgaaccaataccccatcctagcaacattgaaatcccccttgatagcaagacttttctttcccggcattcacttgacatgaagttttcctactgtgatgaaagaatcactgaactgatgggctacgaacctgaagaactccttggccggagcatctacgagtactaccatgcacttgattcggaccatcttactaagacgcatcacgacatgtttaccaagggacaggtgacgaccggacaataccgaatgctggcgaagcggggtggctacgtgtgggtggaaacgcaagcaactgtcatatacaataccaagaattcgcaaccacaatgtattgtgtgtgtgaactacgtggtcagcggaatcattcaacacgatctgatattctcgctgcaacaaactgagtgtgtcctgaaacccgtggaatccagcgatatgaagatgacccagctgtttactaaagtcgaatcggaggatacctcctcactgttcgacaaattgaaaaaggaaccagatgccctgactctgctggcgcccgcagcaggggataccatcatttcactggattttggttccaacgataccgaaactgacgatcaacaacttgaagaggtgcccctgtacaacgatgtgatgctcccgagcccaaacgagaaacttcaaaacataaaccttgctatgagccctctgcctaccgccgagactccaaaacccctcagatcatctgcggaccctgcgctgaatcaggaggtcgcacttaagctggaacctaatcctgaatcactggagctctcttttaccatgcctcaaattcaagatcagaccccatcgccgagcgacgggagcaccagacaatcaagccccgagccaaacagcccaagcgaatactgtttttacgtcgattccgacatggtcaatgaattcaaattggagctggtagaaaaacttttcgctgaagataccgaagcaaaaaacccctttagcacgcaagacaccgaccttgacctggaaatgcttgcaccatacatccctatggatgatgattttcagctccgcagcttcgatcaactttcccctcttgaatcatcgtcggcatcacctgagtcggcatcgcctcaaagcactgtgactgtgttccagcaaacccaaattcaagaacccactgcaaatgcaactactactacggcaaccaccgatgagcttaagactgtcactaaggacaggatggaagatatcaagatacttatcgcatccccttcgcctacccatattcacaaggaaacgacttcggcaacttcgtcgccatacagagatacgcagtcaagaaccgcatccccaaaccgcgcaggaaagggtgtgatagaacagactgagaagtcgcatccaaggagcccaaatgtcctttctgtggcactcagccaacgtaccactgtgcctgaagaagagcttaatcccaagattctggcgctgcagaatgcacaaagaaagcggaagatggaacatgatggctccctgtttcaggcggtcggaattggtacgcttcttcagcagcctgatgaccacgccgcaaccacttcgctgtcctggaagagagtgaagggctgtaagtccagcgagcagaatgggatggaacaaaagaccattattctgattccgtccgacctggcatgtcgcctgcttggacaaagcatggatgaatcaggacttccccaactcacttcatacgattgcgaggtgaacgcgccgatacaaggatccagaaatcttttgcaaggcgaagagctgcttagagcacttgaccaggtcaac

SEQ ID NO: 33101 - DNA, 2478 bp, Artificial Sequence
  Description of Artificial Sequence: Synthetic coding sequence
atggaaggcgccggcggtgcgaacgataagaagaagatatcaagtgagcggagaaaggagaaaagcagggatgcagcccggtcgcggcgatctaaagaatcagaggtcttttacgagctcgctcatcaattgcctctgccccataacgtgtcaagccatctggataaagcctctgtaatgcggttgacgatttcatacctgagggttcgtaagttgctcgatgcgggcgatctggacattgaggacgatatgaaagcccaaatgaactgcttctacctgaaggcgctagacgggtttgttatggtcctgacggacgacggggacatgatctacataagcgacaatgtgaataagtacatgggactgacacaatttgagctaacaggacatagcgtgttcgactttacccatccttgtgatcacgaagagatgagggaaatgttgacccaccgtaatggcctggtcaaaaagggtaaggagcagaacacccaaagaagcttttttttgaggatgaagtgtaccctgaccagccgagggcggaccatgaatatcaagtctgccacctggaaggtgttgcactgcacaggacacatacacgtgtacgataccaactcaaaccagcctcaatgtgggtataaaaaacctcccatgacctgcctggtgcttatctgtgaacccatccctcacccttcaaatattgagatcccactggattctaagacctttttgtctcggcactccctggatatgaagttcagctactgcgacgagaggatcactgaactgatgggctacgagcccgaggaactgctggggcgctctatttacgaatactaccatgccctagacagtgatcaccttacaaaaacacaccacgatatgtttacgaaaggacaggtgacgacaggtcagtacaggatgctcgcgaaaaggggaggctacgtctgggtggaaacacaggctacagtgatttacaacacaaaaaactcccagccccagtgcattgtctgtgtcaactatgtggtgtccggaataatccagcatgaccttattttcagcctgcagcaaactgaatgcgtcctgaagccggtggaaagcagcgacatgaagatgacacagcttttcactaaggtggagtccgaggacacttcatcactctttgacaagcttaagaaagaacctgatgctctgaccctgctagcacctgccgccggcgacactataattagcctcgattttggatctaatgacacagaaaccgatgaccaacagctggaagaggtcccgctgtacaacgatgtcatgttgccctctccgaacgaaaaattgcagaatattaatctggccatgtcgcccctacccactgctgagacaccaaagccactgcgaagctcagccgatcctgctctgaaccaggaggtggctctaaaactcgaacctaatcccgagagtctggagctgagctttaccatgcctcaaatccaggaccagacacccagtcctagcgatggttcaactaggcaatctagccccgagccaaactccccctcagagtactgcttctacgtggactcagatatggtaaacgaatttaaacttgagttggtggagaagcttttcgcagaagatacagaagccaagaatccattttccacacaggataccgatttggacctggagatgttggccccttacattccgatggatgatgatttccagctgaggagtttcgatcagctgagtcctcttgagagtagctcagctagtccagagtccgcaagtccacagagcaccgtgactgtgttccagcaaactcagattcaggagcccactgccaacgcaaccactaccaccgcaacaacagatgagctaaaaacggtgacgaaggataggatggaggacataaaaatactgatagcaagcccctctccaacacacattcacaaagaaacaacgtctgcaacttcatcgccttaccgggatactcagtctaggacagcaagtccaaatagggccggcaagggggtgattgagcagactgaaaagtctcatcctcgatctccaaatgttctgagcgtggcactctctcagcgaacaaccgtgcccgaagaggagctgaacccaaaaattctggctctccagaacgctcagcggaaaagaaagatggagcacgacgggagcctattccaagccgtcgggatcggtaccttactgcagcaacctgacgaccacgctgctaccacctctttgagctggaaacgcgtgaaaggatgtaaaagtagtgagcagaatggaatggaacagaagactattatccttataccatccgacctagcctgccgtcttctgggacaatcaatggacgagtctggcttgcctcagctgacaagttatgattgcgaggtcaacgctccaatccaggggagcaggaatctgctccagggcgaggaactgctccgagcactggaccaggtaaac

SEQ ID NO: 33102 - DNA, 2478 bp, Artificial Sequence
  Description of Artificial Sequence: Synthetic coding sequence
atggaaggtgcaggaggagccaatgacaagaagaaaatctcgagcgaaagacgtaaggaaaagtcacgggacgcagcgcgcagcaggcgctcaaaggaatccgaagtgttctacgagctcgcacatcaacttccacttcctcacaacgtgtcgtcgcatcttgataaggcaagcgtgatgaggcttacgatttcgtacctcagagttagaaagctcttggatgcaggagatctggatattgaagatgatatgaaagcacaaatgaattgtttttacctgaaggcactggacggtttcgtgatggtgctcaccgatgatggagatatgatctacatctcggataacgtgaataagtacatgggacttacgcagtttgaacttaccggtcactcagtgtttgattttactcacccttgtgatcatgaagaaatgcgggaaatgctcacccatcgaaacggtctggtgaaaaaaggtaaagaacagaacacccagcgctcttttttcctcagaatgaagtgcactcttacctctcgtggacggactatgaatatcaagtcggcaacctggaaggtgcttcattgtaccggacatatccacgtgtacgataccaattctaaccaacctcagtgtgggtacaagaaacctcccatgacttgtcttgtgctgatttgcgagccaatcccacacccttcaaacattgagatcccactggactctaagacctttttgtccagacattccctggacatgaaattctcttactgcgacgagagaataactgagttgatggggtacgagccagaggagctgcttggaaggtccatttacgaatactatcatgctctcgattcagaccatctgaccaagacccaccatgatatgtttaccaagggacaggtgaccactggacagtacagaatgctggcgaaacgaggagggtacgtgtgggtcgaaactcaagcaacggtgatctacaataccaagaattcgcagcctcagtgcattgtgtgcgtgaactatgtggtttcaggaatcatacagcacgatctgatcttttcgctccagcagactgaatgtgtgctgaagcctgtggaatcgtcagatatgaagatgacgcagctcttcacgaaagtcgagtcggaggatacctcctccctttttgacaaacttaagaaggagcctgatgccctgaccctccttgcaccagctgcaggtgatactatcatatccctggactttggatctaatgatactgaaaccgatgaccaacaactggaagaggtgcctctgtataatgatgtgatgctgccttcgccgaatgaaaaactccagaatatcaaccttgcaatgtcgcccctcccaacggcagaaactccaaagcccctgagatcctcggccgatcctgcgctgaatcaagaggtcgccctgaaactcgaacctaaccctgagtcactggagctcagcttcactatgcctcaaatacaagaccagaccccgtcaccatcggacggcagcacccgacagagctcccctgaaccaaattccccttccgaatactgcttttacgtggattcagacatggtgaacgaattcaagctggaactggtggaaaagctgtttgcggaggataccgaagcaaagaatccattctccactcaggataccgatcttgacctggaaatgctggccccttacatacccatggatgatgattttcagctgcgttcatttgatcaactgtcacctctggagtcgtcctccgcttccccagaatccgcatcgccgcaatcgactgtcacggtctttcagcaaacccagattcaggagcccaccgcgaacgctacgaccaccactgcaactaccgacgaacttaagaccgtgaccaaggatcggatggaagatatcaagatccttattgcctcgccgtccccgacccatatccataaggagacgacctcggcaacctcgagcccgtacagagatacccagtccagaacggcctcaccaaacagggcaggaaagggtgtcatcgagcagaccgaaaagagccatcctagatcgcccaacgtgctttccgtcgccctgagccagcggaccactgtcccagaggaggaacttaacccaaagattttggctctgcaaaacgcacagcgcaaaagaaaaatggagcacgacggaagcctcttccaggctgtcgggatcgggactctcctccaacagcccgatgatcatgccgccaccactagcttgagctggaagcgcgtcaaaggatgtaagtcctcagagcaaaatggtatggagcaaaaaactatcattctgattccttccgatctggcatgtagactcctgggacagtcgatggacgaaagcgggcttcctcagcttacctcatacgactgcgaagtcaacgcgcctattcagggaagccgtaatctccttcagggcgaggaactgcttcgagccctggaccaggtcaac

SEQ ID NO: 33103 - DNA, 2478 bp, Artificial Sequence
  Description of Artificial Sequence: Synthetic coding sequence
atggagggtgccggaggcgctaacgacaagaaaaagatttcaagtgaaagacggaaagagaaatcacgggacgcggcccgcagtagacggagtaaggagtctgaggtgttttatgaattagcccatcagctgccgctgccccataacgtgagttcgcatctggataaggcaagtgtgatgaggcttaccatctcgtacctgagagttagaaaactactggacgcgggggatctggatattgaggatgatatgaaagcacaaatgaattgcttttacttaaaggcactcgatggcttcgttatggtgttaacagacgacggagacatgatatacattagcgataatgtcaataaatacatgggcctgacacaatttgagctgaccgggcatagtgtgtttgatttcacacacccctgcgatcacgaagagatgagagaaatgcttacacacaggaatggcttggttaagaaaggtaaagaacaaaacacgcagcggagcttcttcttgagaatgaagtgtaccctgaccagccgggggcgaacgatgaatatcaaatccgctacctggaaggtcctgcactgcactggacacattcatgtgtatgataccaacagcaaccagccccagtgcggctataaaaagcccccaatgacctgcctggtgctgatatgcgagccaattccgcatccctccaatatcgagatcccgcttgacagtaaaaccttcctttctcgccactcactcgatatgaagttcagttactgcgatgaacggatcaccgagctgatgggctatgagccagaggaacttctgggcaggagcatatacgaatattaccacgcgctcgattccgaccacctgaccaaaactcaccacgatatgtttactaaagggcaggttaccacgggtcagtaccgcatgttagctaagcgcggcggttatgtgtgggtggagacccaggccacagttatttacaacaccaaaaattcccagccccagtgcatcgtgtgcgtgaactacgtggtgagcgggatcattcagcacgatctcatattttccctgcaacagacggagtgcgtcctgaagcctgtggagagcagcgatatgaaaatgacccagttgtttactaaggttgagagtgaagatacttcaagccttttcgacaaattaaagaaggaacccgatgccctgaccctgttggcccccgccgcaggcgacactattataagtctcgattttgggtcaaacgacaccgaaacagatgaccagcagctcgaagaggttcccctgtacaatgatgttatgctcccctcaccaaacgaaaagctgcagaacattaacctagcaatgagccccctgcccacagccgagacacctaaacctctcagatcctctgcagatcctgcactgaatcaggaggtcgctttgaagctggaacccaatcctgagagtctggaactctcattcacaatgccccagattcaggatcagacaccatccccatcagatgggtctactaggcagtcatctcctgagcctaactcccccagcgagtactgcttttatgttgacagcgatatggtgaatgagttcaaactggagctggtggaaaaactgttcgcagaagatacggaagcgaagaacccattctccactcaggataccgacctggatcttgaaatgctggccccctatattccaatggacgacgacttccaactacgaagtttcgaccaattgtctccgcttgaaagctcttctgcttctcccgagagcgctagccctcagtcgaccgtaactgtgttccagcagactcagatccaggagcctactgccaatgctacaaccacaactgctaccaccgatgaactcaaaacagtcaccaaggaccgtatggaggacataaagatcctgatcgcatcacctagtccaactcatatacacaaggagaccacttcagccacttcatccccctatagagatactcagtctcggactgcttcacccaaccgagccggaaagggggtcatcgagcagaccgaaaagtctcacccccgatctccaaacgtcctgtctgtggcccttagccagcgcaccaccgtgccagaagaggagcttaatcctaagattctagccctgcaaaacgcacagcgaaagcgcaaaatggagcacgacgggtcactctttcaagccgttggcatcggtacactcttgcaacaacccgacgatcacgcggcaacaaccagcctctcttggaagcgagtgaaggggtgcaagagctcagaacagaacggcatggagcagaagacgatcatccttattccatcagatctggcgtgtcggctgctcggccagtccatggacgaatccggtttaccacagctaaccagctacgactgtgaggttaatgctcccatccaagggtctcggaacctcctgcagggggaagagctgctacgcgccctcgaccaggtgaat

SEQ ID NO: 33104 - DNA, 2478 bp, Artificial Sequence
  Description of Artificial Sequence: Synthetic coding sequence
atggaaggtgcaggcggtgcaaacgacaagaagaagatatcatccgaacggagaaaggaaaagagccgggacgcagcccgctcgagaagaagcaaggagtcggaagtgttttacgagctggcacatcagctgcctcttccccacaacgtctcgtcccaccttgataaggcatccgtcatgagactcactatttcctaccttagggtgcggaagctgctcgacgccggcgatcttgatatagaggacgacatgaaggcccaaatgaactgcttttacctgaaggcacttgatgggttcgtcatggtccttactgatgatggggatatgatttacattagtgataacgtgaacaagtacatgggactcacccaattcgaactgactggtcattcggtgttcgacttcacccatccttgcgaccatgaagagatgagggaaatgcttactcacaggaatggtctggtgaagaaaggcaaggagcaaaacacgcagagatcattcttcctcagaatgaagtgtaccttgacctcgcggggtcgaaccatgaatatcaagagcgccacctggaaggttctgcactgtaccggccatattcatgtgtacgatactaactcgaaccagccacaatgtggatacaagaagccgcctatgacttgtcttgtgctgatttgtgaaccaatccctcatccctccaacattgagattcctcttgatagcaagactttcttgtctcggcattccttggatatgaagttttcatactgtgacgaacgcattaccgagttgatggggtacgaacccgaagagttgttggggcgaagcatttacgaatactaccacgcactcgactcggatcatctcaccaagactcaccacgacatgtttacgaagggtcaggtcaccactggacagtaccgcatgctggcgaagcggggtggttacgtgtgggtggaaactcaagcaactgtcatttacaacaccaaaaactcgcaaccacagtgtatcgtgtgtgtgaactacgtggtgtcgggaattatccagcacgacctgatcttttcgctccaacagaccgaatgtgtcctgaagcctgtggaaagcagcgatatgaagatgacccagctttttacgaaagtggaatcggaagatacctcctcccttttcgataaactcaaaaaggagccagacgcactgactctgcttgcacctgccgccggtgatactatcatttcgctggacttcggaagcaatgataccgagactgatgaccagcaacttgaggaagtcccgctttacaacgatgtgatgctcccatcacctaatgagaagctgcaaaacattaatctggcaatgtcaccactgccgaccgctgaaactcccaagccactgagaagctcggctgatcctgctctcaaccaagaagtcgcactgaagctcgagcctaatccagaatcacttgaactgtcttttaccatgcctcaaatccaagatcagacgccatctccctcagacggatcaacccgtcagagcagccccgaacctaattcaccttccgaatactgcttctacgtcgactccgatatggtgaacgagtttaaacttgaattggtggagaaactgttcgcggaagataccgaagcaaagaaccccttttcgactcaagacaccgatcttgatctcgagatgcttgcaccctatataccaatggatgatgactttcagctccgctcatttgatcaactctctccgcttgaaagctccagcgcatcacccgaatccgcctcaccacaatccacggtgaccgtgttccagcaaacccagatccaagaacctaccgcaaatgctaccacgactaccgccacgactgacgagctcaaaaccgtgaccaaggatcgtatggaagatatcaagattcttattgcatcaccgagcccaacccatattcacaaggaaactacttccgcaaccagctcgccttacagggacacccagtcgagaacggcttcgccgaaccgggcaggcaagggagtgatagagcagaccgaaaaaagccatccacgttcccctaacgttctttcagtggccctctcacaacggactactgtccccgaggaagaactgaaccctaagattctcgcacttcagaacgcacagcgcaagcggaagatggagcatgatggatcgctttttcaggcagtgggaattgggacgcttctgcaacaaccagatgaccatgcggctactacctccctgtcatggaagcgcgtcaaggggtgtaaatccagcgaacaaaatgggatggaacaaaagactatcattctgattccttcagacctggcatgccggcttctcgggcagagcatggatgaatcaggtctgcctcaactcactagctacgactgtgaagtcaacgcgcctatccaagggtcgcggaaccttcttcagggagaagagctgctgcgggcacttgaccaggtgaat

SEQ ID NO: 33105 - DNA, 2478 bp, Artificial Sequence
  Description of Artificial Sequence: Synthetic coding sequence
atggagggtgctggcggggctaatgacaagaagaaaattagctctgaacgtaggaaagaaaaaagccgggacgccgctagatcgagacgctccaaggaatccgaggtattctatgaattggcacaccaattgcctctcccgcataacgtttcctctcatctggacaaggcctcggttatgcggctgacgatttcttatcttcgcgtgcgcaaattactagatgctggggacctcgacatcgaggatgatatgaaggcacagatgaactgcttttatctgaaggccctggatggctttgttatggtgctgacagatgacggtgatatgatctatatctctgacaacgtgaataagtatatgggtctgacccagtttgaactgaccggacactcagtgttcgacttcacccacccatgtgaccatgaggagatgcgggaaatgttgacacataggaatggattagtaaagaaaggaaaagagcaaaatacacaacgatcctttttccttagaatgaagtgcaccctcacctcccgcggtagaactatgaatattaaatcagccacttggaaggtcctgcactgcaccggtcacatccacgtatacgacactaactccaaccagccacagtgcggttacaaaaagcccccaatgacctgtctcgtgcttatctgtgagcccatccctcaccccagcaatatcgagattcctcttgatagcaagactttcttatccagacattccttagatatgaagttcagttattgcgacgagcggattacagaactgatgggatacgagcccgaggagctcctggggagaagcatttatgaatattaccacgcactggattcagatcacctgacgaagacccatcacgacatgtttacgaaaggccaggtgaccactggccaataccgtatgcttgcgaaaaggggcggatacgtgtgggtcgaaacccaggctaccgtcatttataatacaaaaaacagccagcctcagtgtatcgtgtgtgttaactacgtcgtaagcgggatcatccaacacgatctgatcttttctctccagcaaacagaatgtgtgttaaagccagttgaatcctctgacatgaagatgactcagctgttcacaaaggtagaatcggaggatacaagctcactgttcgataaattgaaaaaagaacctgacgccctcacactcctcgctccagcagctggtgataccattatctctctggattttggcagcaacgatactgagacagacgatcagcagctagaagaggtgccactctataatgatgtcatgctgccctcccctaacgaaaagctccagaatattaatctggccatgagccctctaccaaccgccgagacaccaaagcctctcagatccagtgccgatccagctctaaaccaggaggtggccctgaagttggagccaaatcccgagagtcttgagctatctttcactatgccccaaatacaggaccagacaccctccccttcagatgggagcacccgccaaagctctccagagcctaatagtccaagtgaatactgtttctatgttgactccgatatggtgaacgaatttaaactggaactggtggagaaactcttcgccgaggacaccgaggccaagaatcccttcagtactcaggatactgacctggacttggagatgttggccccgtatattcccatggacgatgacttccagctgagaagcttcgatcagctgagtccactagagtcttctagcgcgtctccagaaagcgcttctccccagtccaccgtgacagtgtttcagcagacacaaatccaggagcctactgccaatgcaactaccaccacggctactacggacgaactaaaaacagtgacaaaggacaggatggaagacataaagatattaatcgcctctccttctcccacacatatccacaaagaaacaacttcggcaacatcaagcccctaccgggatacacagtcgaggacagcaagccctaacagagctggcaaaggcgtgatcgagcagaccgaaaagagtcatcctcggtccccgaacgtcctctctgtggctctgtcacagcgcaccactgttccagaggaagaactcaacccgaagatcctagctctgcagaacgctcagcgaaagcgaaagatggagcacgatggctctctgtttcaggccgtagggatcgggacccttctccagcagccagatgatcacgctgccacgacctctttgagctggaaaagggtaaaaggctgtaagagcagcgaacagaatgggatggagcagaagaccataatacttatcccgtccgacctggcttgccgattgttgggacagtccatggatgagtcaggcttgccgcagctgacatcatacgactgtgaggttaacgcccctatacaaggcagtcggaacctgctgcagggcgaagagttattgcgcgcactcgatcaggtgaat

SEQ ID NO: 33106 - DNA, 2478 bp, Artificial Sequence
  Description of Artificial Sequence: Synthetic coding sequence
atggaaggcgcaggcggtgccaacgacaaaaaaaaaatttcttcggagcgacgcaaggaaaaatctagggacgcagctcgtagtcgacgtagcaaggagtcggaggtcttctacgaacttgcgcaccagctccccctaccacataatgtctcatctcatcttgataaggcttccgtaatgaggttgaccatttcctatctgagagttcgcaaactgctcgacgctggagaccttgacatcgaagatgatatgaaagctcagatgaattgcttctatctcaaggccttggatggcttcgtgatggtgcttacagatgatggcgatatgatttatatttcagataacgtaaacaagtacatggggctgacacaatttgaacttacgggccatagtgtattcgatttcacccatccttgcgaccatgaagaaatgcgcgaaatgttgactcatcggaacggtctagttaaaaaaggtaaggagcaaaacacccaacgctctttcttcctgcgtatgaaatgcacactgactagcagaggccgcacaatgaatattaaatccgctacctggaaggttttgcattgcacgggtcatattcacgtttatgacacaaactccaatcaaccgcaatgtggatacaagaaaccaccaatgacgtgcctcgtcctaatctgtgagccaattccacatccatctaatattgaaatccctttggattccaagacctttcttagtcggcactcactcgacatgaaattcagttactgcgatgaacgtataacggagttgatgggttacgaacctgaggaactcttgggcaggagtatatatgaatactatcacgcgctcgattccgaccatctaacaaagacacaccacgacatgttcactaagggacaagtaaccacaggccagtaccgcatgcttgccaagcgcggtgggtatgtctgggtggagacgcaagccacggttatctataatacgaagaactctcagccccagtgcattgtttgcgtcaactacgttgtctcgggaatcattcaacatgaccttatattctcacttcaacagacggaatgcgtcttaaagccggttgaaagcagcgatatgaaaatgacccagcttttcactaaagtggagagcgaggatacgagcagcttgtttgataagttaaaaaaggagccggacgccctgaccctactcgcgcccgccgcaggtgataccataatcagcttggatttcggatcaaatgatactgaaacagacgatcagcagctggaggaggttcctctttacaacgacgttatgctcccgtcacctaacgaaaagctacaaaatatcaatcttgccatgtcaccactgccgactgctgaaacccctaagccccttcgctcatcggctgaccctgcgctcaatcaagaggtcgccctaaagttggagcccaatcctgagtccctcgagctgtcgttcactatgccgcaaatccaggatcagacccccagcccctccgacgggtcgactcggcagtccagcccggaacccaattccccgtctgagtactgcttttacgtggattcggacatggttaatgagttcaagctcgaacttgtcgagaagctcttcgcggaagacaccgaggcaaagaacccgttcagcacacaagatacggacctggatttggagatgcttgctccttacatacctatggatgatgatttccagctgagatcgttcgaccaactgagcccacttgagagttcttcagcgtcgcccgagtcagcttctccccagtccacggtgacggttttccaacagacgcaaatccaggagcccacggctaatgcgaccactactaccgcgaccaccgacgaactgaagaccgtgactaaagatcgtatggaagatataaagatcctcattgcaagccccagtccaacgcatatccacaaggaaactacatctgccacgagttctccgtatcgggatactcagagccgcacggctagtcctaatcgggcaggtaaaggtgttatcgagcagaccgagaagtcccatcctcggagccctaatgttctctctgtggctctgtcccaacggactaccgtcccagaggaggagctgaatcccaagatacttgcactgcagaacgctcaacgtaaacgcaaaatggaacacgacggatccttattccaggcagtcggtattgggacactgcttcagcaaccggatgaccatgctgccaccaccagcttgtcttggaaacgggtaaaaggctgcaaatcgagtgaacagaacggtatggagcagaaaaccatcattctgatccctagtgaccttgcgtgccgattgctcggccagtctatggatgagagcggtttaccacagttgaccagttatgactgcgaagtcaacgcacctattcagggttcacgaaatctcctccaaggcgaagagttgctcagagctttagatcaggttaat

SEQ ID NO: 33107 - DNA, 2478 bp, Artificial Sequence; identical to SEQ ID NO: 33084
  Description of Artificial Sequence: Synthetic coding sequence

SEQ ID NO: 33108 - DNA, 2478 bp, Artificial Sequence
  Description of Artificial Sequence: Synthetic coding sequence
atggaaggggcaggcggtgcaaacgacaagaaaaagatttcctcggagagaagaaaagagaagtcgcgggacgcagcaagatcaaggcgctcaaaggagtcggaagtgttttacgaattggcccatcaactgccgctgccacataacgtgtcgtcacacctcgataaagcaagcgtgatgcggttgaccattagctaccttcgggtgagaaaactgctggatgccggagatctggatatcgaagatgacatgaaggcacagatgaactgtttttaccttaaggccctggacggatttgtgatggtgctcaccgatgatggagatatgatctacatctccgacaatgtgaataagtacatgggtttgactcaatttgaactcactggtcattcagtttttgatttcacgcatccttgtgatcacgaggaaatgcgggaaatgcttacccatagaaacggcctggtgaagaaaggaaaggagcagaatacccagaggtcattctttcttcgtatgaagtgtacgctgacttcgagaggtcgcacgatgaacataaagtcggccacctggaaggtgttgcactgcaccgggcatattcatgtctacgacacgaattccaatcagccccaatgcggatacaagaagcctccaatgacttgcctggttctcatctgtgagcccatcccccacccaagcaacatcgagattcctctcgattctaaaactttcttgagtcgccacagcttggatatgaaattctcctactgcgatgagcgaatcacggaactgatgggttatgagccagaagaactccttggaagatccatctacgagtattaccatgccctggacagcgatcatcttaccaaaacccatcacgacatgtttaccaaagggcaagtcactaccggtcaataccgtatgcttgctaagcgcggcggatacgtgtgggtggaaacccaagctactgttatctacaacacgaagaattcgcagcctcaatgcattgtctgcgtcaactatgtggtttcaggcattattcagcatgacctgatcttttcacttcaacagacggaatgtgtgctcaaaccagtcgagtcaagtgatatgaaaatgacccaactttttactaaggtggagtcggaagatacttcctcactgttcgataaacttaagaaagaacccgacgcgttgaccctccttgcaccagccgcgggggataccataatctctctcgactttggaagcaatgacacggaaactgatgatcaacaactcgaagaagtgcccctgtacaacgacgtgatgctgccttcacctaacgaaaagttgcaaaacataaatcttgcaatgtcgccgctgcctacggctgaaactcccaaaccacttagatcgagtgctgaccctgcgcttaaccaagaggtggcacttaaacttgagcctaaccccgagtccttggaactttcgtttacgatgcctcagattcaggatcagaccccctccccatccgatggatccacccgtcagagttcgcctgagcctaactccccaagcgaatactgtttctacgtggatagcgacatggtgaacgagtttaaacttgaacttgtggagaaacttttcgcggaagataccgaagcgaagaacccatttagcactcaagataccgatcttgatctggaaatgctggccccttacattcctatggatgatgattttcagctccggtcgttcgatcagctgagcccacttgaatcatcgtctgcatcccccgaatccgcctcacctcaatcaaccgtgactgtctttcaacagacccaaattcaagaacctaccgccaatgcaactaccaccaccgctactactgacgaactgaaaactgtcactaaggaccggatggaggatatcaagattctgattgcttcgccttcacccacccatattcacaaagagactacgtccgcaacctcctccccttacagagacacccaaagccgcacggcttcgccgaatagagccggtaagggcgtgattgaacaaaccgagaagtcacatcctcggtcaccgaacgtgctgtcggtggcactgtcacagcgcactaccgtgccggaggaggaactgaaccctaagatactcgcactccaaaatgcccagaggaaacgaaagatggagcatgacggaagcctcttccaagcggtggggatagggactttgcttcaacaacccgacgaccacgcagccaccacctcgctctcgtggaagagagtgaagggttgtaagtcgtcggagcagaatggcatggaacagaaaaccattatcctcattccaagcgatttggcgtgtaggctgcttggacagagcatggacgaatcggggctgccccaactcacgtcctacgactgtgaagtgaacgcacctattcaaggctcacgaaacctcctccagggcgaagagctgcttcgggcgctggaccaggttaac

SEQ ID NO: 33109 - DNA, 2478 bp, Artificial Sequence
  Description of Artificial Sequence: Synthetic coding sequence
atggaaggtgcaggaggtgcaaatgataagaagaagatctcgagcgaaagaagaaaagaaaagtcgagagacgcagctagatcgaggcggtcgaaggaatccgaagtgttctacgaactggcccatcaactgccccttccccacaatgtgagcagccatcttgataaagcgtcggtgatgagactgactattagctaccttagagtccgaaagttgcttgacgccggtgatctcgacatagaggacgacatgaaggcacagatgaactgcttttatctgaaggcccttgacggatttgtgatggtgctcactgacgacggcgacatgatttacatttcggacaatgtcaacaaatacatgggcctcactcagtttgagcttaccggacactccgtgtttgatttcactcatccctgcgaccacgaggagatgagggagatgctcacccatcgcaacggactcgtcaagaaggggaaggaacaaaacacccaaaggtccttcttccttcgcatgaagtgtactctcacctcgcgcgggcggaccatgaacattaagagcgcgacttggaaggtgctgcattgtactggtcacattcatgtgtacgacaccaattcgaatcaacctcaatgcggatacaaaaagccaccaatgacttgcctcgtgcttatatgcgaaccaattccacatccatcgaacattgagattccgctcgattccaagacgtttctgtcacggcattcgctcgatatgaagttttcatactgtgatgaaaggattactgaactcatgggctacgagccagaggaattgctgggcagatccatttacgaatactaccacgcattggatagcgatcatcttactaaaacgcatcatgacatgttcaccaagggtcaagtgaccaccggacaatacagaatgctcgcgaagcggggaggatatgtctgggtggaaacccaggcaactgtgatttacaacactaagaattcccagccccaatgtatcgtgtgtgtcaactatgtggtgtcgggcattattcagcatgaccttatcttctcactgcaacagactgaatgtgtgctgaagcctgtcgaatcgagcgacatgaaaatgactcagctttttactaaggtggagagcgaagatacctcaagcctctttgataagctcaagaaggagcctgacgcattgaccctcctcgcccctgcagcgggggataccatcatatcattggattttggaagcaacgatacggaaaccgacgaccagcagctggaagaagtccctctttacaacgatgtcatgctgccgtcgcctaacgaaaaactgcaaaacattaacctcgctatgtcgccactgcccactgcagaaactccgaagcccctgagatcgagcgccgatcctgcccttaaccaggaggtggccctgaagctggagccaaaccctgaatcccttgaactcagctttaccatgccacaaattcaggaccagaccccttcgccctcggatgggtcaacccgacaatcctcccctgaacctaacagcccgtcagaatattgtttttacgtggactctgatatggtgaatgagttcaagttggaactggtcgagaaacttttcgccgaagataccgaagctaagaaccccttctctacccaagataccgatcttgatttggagatgctggcaccttacataccaatggatgatgattttcagttgcggagcttcgatcagctgtcgccactcgagtcatcctcggcttcgcctgagtcggcatccccacaatcgacggttaccgtgtttcaacagactcagatccaggaacctactgcaaacgcaactaccaccaccgcgactacggatgagctcaaaactgtcactaaggatcgcatggaggatatcaaaattcttatcgcctccccttcgccgacgcatatccataaggaaaccacctccgcaacttcgtctccttaccgggatactcaatccaggaccgcatccccgaatcgtgcaggcaagggcgtgattgagcaaactgaaaagagccacccccggagcccaaatgtgctctcggtcgccctttcgcagcggaccactgtcccggaggaagagttgaatcctaagatacttgcattgcaaaatgcacagcgaaaacgcaagatggaacatgatggctcactgtttcaagcagtgggaattggaactctgctccagcaaccggacgaccacgcagcaacgacctcactctcatggaagagagtgaagggatgtaagtcctcagaacaaaatggcatggaacagaaaacgatcattttgattccttcggacctggcctgtcgtctcctgggtcaatcgatggatgaatccgggcttccacagctgacctcgtacgattgtgaggttaatgcccctatccagggaagcagaaacttgcttcagggggaagaacttcttagagccctcgatcaggtgaat

SEQ ID NO: 33110 - DNA, 2478 bp, Artificial Sequence
  Description of Artificial Sequence: Synthetic coding sequence
atggaaggtgccgggggagcgaacgataagaagaagatctcatccgaacgtagaaaggaaaagtcccgcgatgccgcacgctccagaagaagcaaggaatccgaggtgttctatgagctcgcccatcaactcccgcttccacataatgtgtcgtcgcaccttgacaaagcgtcagtgatgagactgactatctcatacttgagggtgcggaagctccttgatgccggagatctggatatcgaggatgatatgaaggcccagatgaactgcttctatcttaaggcactggatggcttcgtgatggtgcttactgacgacggcgatatgatctacatttccgacaacgtcaacaagtacatgggtctgacccagtttgagctgaccggacactccgtctttgattttacccacccttgcgatcatgaagaaatgcgcgaaatgctcactcatcgcaatgggttggtgaagaagggaaaagaacaaaacactcaaagatccttttttctgcgcatgaaatgtactctgacctcaagaggaagaaccatgaacattaagtcggcaacgtggaaggtgctccattgtaccggacacatacatgtgtacgacactaactccaaccagccacaatgcggttacaagaagcctcccatgacctgcctggtgctgatctgcgaacctatcccgcacccatcaaacatcgaaatcccgcttgattcaaagacctttctctcaaggcattctcttgatatgaagttttcctactgtgatgagcgcatcactgaacttatgggttacgagccagaagaacttctgggacgttcaatctacgagtactaccatgcactcgactctgatcaccttactaaaactcatcatgacatgttcactaagggtcaagtcaccaccggccaatacaggatgctcgcaaagcgaggaggttacgtctgggtggagactcaggccactgtcatctacaacaccaaaaacagccaaccccaatgcatcgtgtgcgtgaattatgtggtgagcggaattatccaacacgacttgatctttagcctgcagcagaccgaatgtgtcctcaaaccagtggagtcatccgacatgaagatgactcaactgtttacgaaagtggagtccgaagatacctcgagcctgtttgacaaacttaagaaagagcccgacgcccttacgctccttgctccagcagccggggatacgatcatttcgctggatttcggcagcaatgacaccgaaaccgatgaccagcagttggaggaggtccctctttacaacgatgtcatgcttccctcaccaaacgaaaagctccaaaacattaatctggcgatgtctccactgccaacggccgagacgcctaaaccattgcgatcctcggcagaccccgccctcaatcaagaagttgcgctgaagttggagccaaacccagaatcccttgaactcagcttcaccatgccacagatccaagatcaaaccccaagcccaagcgatgggtctacccggcaatcgtcccccgaaccaaactcgccctcggaatactgtttctacgtcgactccgacatggtgaatgagttcaagctggagctggtcgagaaactttttgcagaagataccgaagccaaaaacccttttagcacgcaggataccgatcttgaccttgaaatgctggctccgtacatacctatggatgatgatttccaattgcggagcttcgatcagctgtcgcccctggaatcgagctccgcaagccccgagtcggcaagcccgcaaagcactgtgaccgtctttcagcaaactcagatccaagagccaaccgcgaatgcgaccacgacgactgcaactactgatgaactgaaaaccgtgactaaggataggatggaggatatcaaaattcttattgcctcccctagcccaactcacatccacaaggaaaccacttccgccacctcatccccgtacagagacacccaaagcagaacggcatcgcccaacagagccggaaagggagtgattgaacagacggagaaaagccatcctcgaagcccaaacgtgctctccgttgcactctcacaacggaccaccgtgccggaagaagaactgaaccctaagatactggcactgcagaatgcccaacggaaaagaaagatggaacatgacggctctctctttcaagccgtgggaattggtaccctgcttcagcaaccagacgatcatgcagcgaccacttcgctttcgtggaagcgcgtcaagggttgcaagtcgtccgagcaaaatggaatggagcaaaagaccataattcttattccttcagatcttgcatgtagactgctcggtcagagcatggatgaatcggggctgcctcaactgaccagctacgattgtgaagtgaacgctcctattcaggggagccggaacctgctgcaaggagaggaactcttgagggcactcgatcaggtgaat

SEQ ID NO: 33111 - DNA, 2478 bp, Artificial Sequence
  Description of Artificial Sequence: Synthetic coding sequence
atggaaggcgccggaggagcaaacgacaaaaagaagatctcatcagaaaggaggaaggagaagtcgcgcgatgcggcccgatcccgccgaagcaaggaaagcgaggtgttttatgagctggcacatcagcttcctctgccacataacgtgtccagccatctcgataaggcctcggtgatgcgattgactatatcgtacctgcgagtgcgaaagctgcttgatgcgggggacctggatattgaggacgatatgaaggcccagatgaattgtttttacctgaaggctctcgatggttttgtgatggtccttaccgatgatggggatatgatttacatttcggataacgtgaataagtacatgggattgacccaatttgaactcacgggccatagcgtgtttgattttactcacccttgtgatcacgaagaaatgcgggagatgcttactcatagaaacggactggtgaagaagggtaaggaacaaaacactcaaagatcgtttttccttcggatgaagtgcaccctgacttcaagaggaaggaccatgaacataaagtcagcaacctggaaggtgctgcactgtacgggacatatccatgtttacgatactaactcaaaccagccccaatgtgggtacaaaaagcctcctatgacttgcctggtgctcatttgtgaacctattccgcacccctcgaacatagaaattcctctcgactcaaagactttcctctcccggcattccctggacatgaagttttcctactgcgacgaacgcataactgagcttatgggatacgagccagaagaactgctggggaggtctatctacgagtactaccatgcgctcgactctgaccatctgaccaagactcatcatgatatgtttaccaagggacaggtcactactggacagtacaggatgctggcaaagcgcggaggatacgtgtgggtggaaacccaagccaccgtgatttacaatacgaagaatagccagccacagtgtattgtgtgcgtgaattacgtggtgtccggtatcattcagcatgatctgatctttagcctgcagcaaaccgaatgtgtcctgaaacccgtcgaatcgtccgacatgaagatgacgcagctgtttactaaagtcgagtccgaagatacttcgtcgctttttgataaacttaagaaggaaccagacgcacttactcttctggcgcctgcagctggtgatacgataatctcccttgattttggatcgaatgataccgaaaccgatgaccagcaactggaagaggtgccactttacaacgatgtgatgctgccatcgcctaacgaaaaactgcagaacattaatcttgcaatgtcgcccctgccaaccgcggaaaccccgaagccacttcgctccagcgcagaccctgcgctgaaccaagaggtcgcactcaagctcgaacctaaccctgagtcgcttgaactttcatttacgatgccacagatccaggatcaaactccgtcgccttccgacggatccactagacaatcgtcgcccgaacccaattcaccaagcgaatactgtttttacgtggattctgatatggtcaacgaattcaagctggagttggtcgaaaaacttttcgccgaagatactgaagccaaaaacccattcagcactcaagacaccgatttggacctggaaatgcttgcaccttacatccctatggatgacgatttccaactccggagctttgatcaactttcgccacttgaatcatcgagcgcatcaccagaatccgcctcgccccagtcgactgtgacggtttttcaacagacccagattcaagaaccaacggcaaacgcaaccaccaccactgcaactactgatgagctgaaaaccgtgaccaaggaccgcatggaagatatcaagattctcatagcctcgccatccccaactcacattcataaggaaacgacttcagcaacctcgtcgccttacagagatactcagtcgaggaccgcatcgcctaaccgggcaggaaagggcgttatagaacagactgagaagtcgcaccccagatcacctaatgtgctttccgtcgccttgtcccagcgcactaccgtgcccgaagaagaattgaacccaaagatcctcgcacttcaaaacgcacaaaggaaaaggaaaatggaacacgatggatcgttgtttcaggcagtcggtatcggaaccctcctgcaacaaccagatgatcatgcggcaactacctcgctgtcatggaaacgggttaaaggttgtaagtcatctgaacagaatggaatggaacaaaagaccataattctgatcccctccgatctggcgtgcagactcctcggacaatccatggatgaatccggcctgccacaacttacttcatacgactgtgaagtcaacgcccctattcagggctcacgaaaccttctccaaggtgaagagctgcttagagccttggaccaggtgaac

SEQ ID NO: 33112 - DNA, 2478 bp, Artificial Sequence
  Description of Artificial Sequence: Synthetic coding sequence
atggagggggcgggtggggcgaatgataaaaaaaagatttcctctgaaagaagaaaggagaaatcccgggacgccgctcggtccaggaggtccaaagagtcagaagtcttttatgaactggcccatcagctccctttgcctcacaatgtcagttcccacttagacaaagcgtcagtgatgcgactaactataagttatctgagagtcagaaagctattggacgctggtgacttggacatcgaggacgatatgaaggcccagatgaattgtttttacctgaaggccttggatggctttgtcatggttcttaccgacgacggcgacatgatctacatctctgataacgttaataagtacatggggctaacccagttcgaactgaccggccattcagtattcgatttcactcacccctgcgaccatgaagaaatgcgggaaatgctgactcataggaatggcttggtcaaaaagggcaaggagcagaacacccagagatcgttcttcctgcgaatgaaatgtaccttgacaagccgcggcaggacaatgaatataaaaagtgcaacgtggaaagtcctgcattgtacagggcatatccacgtttacgatacgaactcgaatcagccccagtgcggatacaaaaaaccccctatgacgtgcctggtcttgatctgcgagccaataccccacccgtccaatatcgaaatcccgcttgattccaaaacctttctttcccgccactccttggatatgaagttctcgtactgtgacgagagaatcacagagctgatgggttacgaacccgaggaactgctcgggcggagcatatacgagtactatcacgccctagactcagaccacttgactaagactcatcatgacatgttcacaaagggccaggtgaccaccggacagtatcgcatgttggcaaaacgtgggggctacgtgtgggtggagactcaggccaccgtgatttacaacacgaagaattcccagccgcagtgcattgtatgcgtgaactacgtggtttctgggattatccaacacgacctgatcttttccctccagcagactgaatgcgtgctgaagcccgtggagtcttcagacatgaaaatgacacaattgtttactaaagtggagagcgaagacacgtcttccctgtttgataaacttaagaaagaaccagatgccctgacgcttctcgctcctgccgctggggacacaattataagcctggactttggttccaatgacactgagaccgatgaccagcagctggaagaggtccccctgtacaatgatgtgatgctgcctagtcctaacgagaaactgcagaacatcaatctggccatgagtccgctgcccaccgcagagactccaaagccccttagaagttccgccgatcctgcactgaatcaggaggtggctctgaagttagaacccaacccggaaagtctagagctctcattcacaatgccccagatacaggaccagacaccctcacccagtgacgggagtacccggcaatcaagtccagagcctaatagcccctcagagtactgtttctacgtggattccgatatggtgaacgagtttaaattagagctggtggaaaagctgtttgctgaggacacagaggcaaaaaatcctttttccacacaggatacggatttggacctggaaatgctggctccatacatccccatggatgatgatttccagttaagaagtttcgatcagctgtcgccgctagagagttcgagcgcgagccccgagtccgcatccccccagagcactgtgaccgtgttccagcagacacagattcaggaaccaaccgccaacgcaaccactacaacggcaaccactgatgaactgaaaaccgtgacgaaggaccgcatggaagacattaagatcctgattgcatctccatcccctacgcacatacacaaagagaccaccagcgcgacctccagtccctatcgcgacacccagtccaggacagcctcgccgaacagagcgggaaagggagtgattgagcaaactgaaaagagccatcctcgaagccccaatgttctgagtgtggcgctgtctcagaggactaccgtccccgaagaggagctgaacccaaaaatcctcgctctgcagaacgcacagcgcaagcggaagatggaacatgatggctcccttttccaggcggtaggcatagggacgctgctgcagcagccggacgatcatgctgctaccacctcacttagttggaagagggtaaaaggttgtaagtctagcgaacagaatggaatggagcaaaagactatcatcctgatccccagcgatctcgcctgccggttgcttggccagagcatggacgaaagcggactccctcagttaacctcatacgattgtgaagttaacgctcccattcagggcagcagaaatctgttacagggggaagagttgcttagggctctcgaccaggttaat

SEQ ID NO: 33113 - DNA, 2478 bp, Artificial Sequence
  Description of Artificial Sequence: Synthetic coding sequence
atggagggagctggaggcgcaaacgataagaaaaagatctcaagcgagcgtagaaaagagaaatccagggatgcagccagatcacgtcgttctaaagagagcgaggtgttttacgaactagctcaccaactgccactgcctcacaatgtcagtagccatctggacaaagcctctgtcatgcgtcttaccatcagttacctcagggtccgtaaactattggatgcaggggatctggatatcgaagatgacatgaaagcccaaatgaactgtttttatctcaaagccctcgatggtttcgtcatggtgctcactgatgatggcgacatgatctatatctccgataacgtgaataaatatatgggactcacccaattcgagctaacaggccattctgtcttcgatttcactcatccctgcgaccacgaggagatgagggagatgcttactcaccggaacggcctggtcaagaaggggaaggaacagaacactcagcgaagtttcttccttagaatgaagtgtacactcaccagtcgcggacgcactatgaacataaagtcagctacctggaaggtcctgcactgcacaggacatatacacgtatatgatacgaactccaatcagcctcagtgtgggtacaaaaaaccacccatgacatgcctggtgctaatctgcgaacccatcccacaccctagcaacatagagatcccactggattcaaagacattcctgtctaggcacagcttggacatgaaattctcttactgcgatgaaagaataacagaactcatggggtatgaaccagaagagctcctcggacgttctatctatgagtactaccatgcgctggactccgaccaccttaccaagacccaccatgacatgtttacgaaaggtcaggttacaacaggacaatatcgaatgctggcgaagcggggaggctacgtgtgggtcgaaacccaggccaccgttatctacaacactaagaattctcagccacagtgtatcgtgtgtgtgaactacgtggtgtctgggatcatccagcacgatctcatattctctttgcagcagactgaatgcgtgctgaagcccgtggagtctagcgatatgaaaatgacccagctcttcactaaggtggaatcagaggatacgagctcactgtttgacaagctgaagaaggagcctgacgccctcaccctgctggcacctgccgccggggatactatcatctcactggacttcggatcaaacgataccgaaaccgatgatcagcagttggaggaggtcccactttacaatgatgtcatgcttcccagtcccaatgaaaagctgcagaatatcaatctggctatgtcacccctccccactgctgagaccccaaaaccactacgttcttcagctgaccccgctcttaaccaggaagtcgccttaaagttggagcccaatccagaatccctagagctaagctttactatgcctcagattcaggatcaaacaccgagcccatcagacggtagtacacgccagtcctctccagagcctaattctccttcagagtactgcttttacgtggatagtgacatggtgaatgaattcaaattggagttggtggagaagctcttcgcagaggacacggaggccaaaaatccgttcagcacacaagacaccgaccttgatcttgaaatgcttgctccctatatcccaatggatgatgattttcagctgcgaagtttcgaccagttatctccattagaaagcagctctgcctctcctgagtctgctagtccgcaatctacagtgaccgtcttccagcaaacacagatacaagaaccaactgcaaatgcgacaacgactaccgccaccactgacgagctgaagacagtgactaaggacaggatggaggatattaaaatcctgatagcttctcctagccctacccatatacacaaagagacaacatccgccacatcttcgccttacagggatacgcagtctcgcactgcatcacccaacagagccggcaaaggagtcattgaacaaaccgagaagagtcacccccgatccccgaatgtactctccgttgccctgagtcagagaaccacagtgcctgaggaggagttaaatcccaagatcttagctctacagaatgcgcagcggaaacgaaagatggagcacgacggatcactgttccaggcggtaggtatcggcacactcctgcagcaacccgacgaccacgcagccactacctccctgtcatggaaacgcgtcaaagggtgtaagtccagcgaacaaaacggtatggaacagaagacgatcatcctgatccccagcgatttggcctgtagactgctgggccagagcatggacgagagtgggctcccccaattaacaagttatgattgcgaggtgaatgcccctattcaaggaagtcgcaacctgctccaaggcgaggagcttttacgagcactggaccaagtgaat

SEQ ID NO: 33114 - DNA, 2478 bp, Artificial Sequence
  Description of Artificial Sequence: Synthetic coding sequence
atggagggagcaggtggagccaatgacaagaaaaagatatcgtccgaaagacgtaaagagaagtcaagggatgcagcccgctcgagacgttccaaagagtcggaagtgttttacgagctggcacatcagcttcctcttcctcacaacgtgagctctcatctggataaggcatcagtcatgcgacttaccatttcgtacctgcgggtgcggaagttgctggacgctggagatctggacattgaggatgatatgaaggcccagatgaactgtttctacctgaaggcacttgatgggtttgtcatggtgctgacggatgacggcgatatgatctacatttcggataacgtgaacaaatacatgggcctcacgcagtttgaacttaccggacattccgtgtttgattttactcatccttgcgatcatgaagaaatgcgggagatgctgacccaccgcaatggtctggtgaagaaagggaaggagcaaaacacccaaagatccttctttctgcgcatgaagtgtactctgacctctcgaggccggactatgaacattaagagcgcaacttggaaggtgttgcattgtaccggtcatatacacgtctatgatacgaactcgaaccagccacaatgtggatacaagaaacctccaatgacctgtctggtgctgatttgcgaaccgattcctcacccttccaacattgaaattcctctcgacagcaaaacctttctttccaggcattccctggacatgaagttttcttactgcgacgagcgtatcactgagctgatgggctacgagccagaagaactcctgggacggtcgatttacgaatactaccacgcccttgattccgaccatctcaccaaaacgcatcatgatatgttcactaagggtcaggtgactactggtcagtaccgtatgcttgcaaaaagagggggctacgtgtgggtcgaaactcaagcaaccgtgatctataacactaagaatagccaacctcaatgcatcgtctgtgtcaactacgtggtgtcggggattatacagcatgatctcattttcagcctccaacagaccgaatgtgtgctcaagcccgtggaaagctcggacatgaagatgacccagctgttcaccaaggtggagagcgaagataccagctcgctgtttgacaaactgaagaaagaacctgacgcccttacgctccttgccccagccgcaggtgataccatcatctctctggattttggatccaacgacaccgaaactgacgatcagcagctcgaggaagtgccgctttacaatgacgtcatgcttccatcgcctaacgaaaaactgcagaacatcaatctggcgatgtcaccactgcctactgcagaaaccccaaagccacttcgctccagcgcggatcctgcactcaaccaagaggtggccctgaaactggaaccaaacccagaatcgcttgaactcagttttaccatgccgcagatccaagatcaaactccctcccccagcgatgggagcacccggcagtcaagccccgagccaaactccccgtcggagtactgcttctacgtggattccgatatggtgaatgagtttaagctcgaactggtcgaaaagctgttcgcagaggacaccgaagcgaagaacccgttttcgactcaggatactgacctcgatctggaaatgctggcaccttacatccctatggacgacgatttccagcttaggtcattcgaccagctttcgccgcttgagtcatcctccgcctccccagaatccgcctcgccccaatccaccgtcactgtttttcagcagacccaaatccaagagcctacggcaaatgcaactacgactactgcaaccaccgatgaattgaaaaccgtcaccaaggatagaatggaggacatcaaaattctgatcgcatcgccttcgcccacgcatattcataaggaaaccacttccgcaacttcgtccccttacagagatacccagtcgagaaccgcatcgccaaatagagcgggcaagggagtgattgagcagaccgaaaaaagccaccctcgttcgcctaacgtcctttcagtggcactttcccagagaactaccgtgcctgaggaggagcttaacccaaagattcttgccctgcaaaatgcacagagaaagcgtaaaatggagcatgacggatcgctctttcaagcagttggtattggtacccttcttcagcaaccagacgatcatgctgcaaccacttcactttcatggaagcgggtgaagggctgtaagtcgagcgagcagaatggaatggaacaaaaaaccattattcttataccttccgatcttgcttgccgactcctgggacagtccatggacgagtcaggccttccacaattgacctcctacgattgtgaagtgaacgcaccaattcagggttccagaaatctgctgcaaggggaagaactgctgagagcactcgaccaagtcaat

SEQ ID NO: 33115 - DNA, 2478 bp, Artificial Sequence
  Description of Artificial Sequence: Synthetic coding sequence
atggaaggggctgggggggcgaatgataagaaaaagataagttctgaacgaaggaaagaaaaatcacgggatgcagccagatccagaagatcaaaagagagtgaagtattttacgagctggctcaccagcttcccctacctcataatgtgtcctcccacttagacaaggcatctgtgatgagacttacaatatcttaccttcgggtgagaaaactattagacgctggagacctggacatagaggacgacatgaaggcccagatgaactgtttctatttaaaggcactggatgggtttgttatggtcctcactgatgacggggatatgatctacatatctgataatgtgaacaaatatatgggactaactcagttcgaactcacggggcattctgtttttgactttactcacccatgtgatcatgaagaaatgcgggaaatgctaactcatcgcaacgggcttgtgaaaaagggaaaagaacagaatactcaaagatcgttttttctgcggatgaaatgtacactgacttctagggggcggactatgaatatcaaatctgccacatggaaagtccttcactgcactgggcatatccacgtctacgatactaactcaaatcagccccagtgtggatataaaaaaccacctatgacttgtctcgtcctaatctgtgaacctatcccccatccatcaaacattgaaataccccttgattccaaaacttttctgtccagacacagtcttgatatgaaattctcctactgcgatgaacggatcactgagctcatggggtatgagccagaagaactattagggaggtctatttatgagtattaccatgccctagactctgatcatcttacaaaaacacatcatgatatgttcacaaaagggcaggtaacaacaggacaatatagaatgcttgctaaacggggaggatatgtgtgggttgaaactcaagcaacagtgatctataatactaagaactcacagccccagtgtattgtatgtgtgaattatgttgtgagtggaatcattcagcatgatttaatatttagtctccagcagactgagtgcgtgttaaaacctgttgaatcttctgatatgaaaatgacacaattgtttacaaaagtggagagtgaagacacaagttccctcttcgataaattaaagaaagagcccgacgcactcacactgctagctcctgccgccggggacactatcatttccctggatttcggaagtaatgatacagaaactgatgatcagcagctcgaagaggtccctctttataacgacgtgatgctgccctctccaaatgaaaaactccagaacatcaatttggcaatgtcacctctgccaacagccgaaacacccaaacccctaagatcaagtgccgatcctgctctgaaccaggaagtagctctcaaattagaaccaaatccagaatcattggaactctcttttacaatgcctcagatacaggaccagacacccagtcctagtgatggatcaacacgccaatcaagtccagaacctaactccccctccgaatattgtttctacgtggattctgatatggtcaacgaatttaaacttgaattagtagaaaaactatttgccgaggatacagaagcaaagaatcctttctctactcaggatacagatcttgatcttgaaatgctggccccctatatccccatggatgatgattttcagctgcggtctttcgatcagctgtctccccttgaatcatcatcagcatcccccgaatctgcaagtccacagtctacagtgactgtatttcagcagacacagatccaggaacccactgccaatgccacaactacaactgcaacaacagatgaactcaaaacagtaactaaagacaggatggaggatatcaagattctaatagcttctccaagtcccacacacatacataaagagactacttctgccactagtagtccctatagggatacacagtcaagaacagcctctccaaacagggctggaaaaggggttatcgaacaaacagagaagtctcatcctcggtccccaaacgttttgtcggtcgcccttagtcagagaacaactgtgcccgaggaggaacttaatcctaagatccttgccctccagaatgcacagcgaaaaagaaaaatggaacatgatggatccctcttccaagctgtggggatcgggacgcttcttcaacagccggatgatcacgcagctacaacaagtctctcctggaaacgagtgaaaggatgtaaatcttctgaacagaatggaatggagcagaaaacgatcatactcatcccttccgatctggcttgtaggctactcgggcagtccatggatgaatctgggttgcctcagctcacatcctatgattgtgaagtgaacgcaccaatccaggggtctcggaatcttctgcagggggaagaactgttacgggctctggaccaggtgaac

SEQ ID NO: 33116 - DNA, 2478 bp, Artificial Sequence
  Description of Artificial Sequence: Synthetic coding sequence
atggaaggcgctggcggggccaacgataaaaagaaaatttcatccgagcgcaggaaagagaaatcaagagatgccgcaagatcaagaaggagcaaagagagtgaggtattttacgagctggcacatcagctgccactgcctcataatgtttcttcccatctggataaagcaagcgtcatgcggctgactatttcatatcttcgagttcgcaagctgctggacgcgggcgaccttgatatcgaggatgacatgaaagctcagatgaactgcttttatctcaaagcgctggatggtttcgtgatggtcttgacagacgatggggacatgatttacataagcgacaacgttaataagtatatgggattgacacagttcgagctgacaggacacagtgttttcgactttacacacccatgtgatcatgaagaaatgcgggaaatgttgacccatagaaatggactggtgaagaaaggaaaggaacagaacacccaacgaagctttttcctccgaatgaaatgtaccctgacgagccgaggaagaacaatgaacataaaaagcgccacatggaaggtgttgcactgtactggacatatacacgtctatgacacaaatagcaaccagccacaatgtggctataagaaaccaccaatgacttgtttggttctaatctgtgaacctattccccacccctcaaacatcgagatccccctcgatagcaaaacattcttgagtcgtcattccttggacatgaagttttcctactgtgatgaaagaataactgagcttatggggtacgagcccgaggagctgcttgggcgaagcatttacgagtactaccacgctttggactccgatcacctcacaaagacacaccatgatatgttcacaaagggtcaggtcacgaccggacagtatcggatgctggcgaagcgcgggggctatgtgtgggtggaaacccaagccacggtgatctataacaccaagaattctcagccccagtgtattgtttgtgtgaattacgtggtaagcggaatcattcagcacgatcttattttctctctccaacagacggagtgcgttctgaaacccgtggagagctctgacatgaagatgactcaactgttcactaaggtggagagtgaggacacatcctccttatttgataagttaaagaaagaacctgatgcactcacactgctggcgcccgcagcaggagataccatcatatctctggattttggctctaacgacactgaaactgacgaccagcagctcgaggaggtgcccttgtataacgacgtcatgctgccttcacccaatgagaagctgcaaaatatcaatttggccatgtctcccctacccactgcagagactccaaaacccctccggagcagcgccgatccagcacttaaccaagaggttgctcttaagctggaacctaaccccgagagtcttgaactcagctttacaatgccacagatccaggaccagactccatccccttccgatgggagcacgcgacagtcctctccggaacccaactctccttccgaatattgcttctacgtcgactctgacatggtgaatgaattcaaactggaattggtggaaaagttattcgccgaggacaccgaagcgaaaaatcctttttcaacgcaggacactgacttggacctagagatgctggcgccctatatccccatggatgatgactttcagcttcgcagctttgatcaactcagccccttggagtcctcctcagcatcgcccgagtcggctagtcctcaatccaccgtgacggtgttccagcaaacccagattcaggagcccaccgctaacgccaccactacgacagctacaactgatgaactcaagactgtcactaaggataggatggaggacattaagattctgattgccagcccctcgccaacccacatccacaaggagacgacatctgccacaagctccccctacagggatacccagtccaggacagcctcccccaatcgagccggaaagggggtgatcgagcagacagagaaatcgcatcccagatcccctaacgttctgtctgttgcactgtcacaaagaacaacagtgcccgaggaagagctgaatcctaaaatcctagcgctccagaacgctcaaaggaagcgaaaaatggagcatgatggcagcctgttccaggccgtcggcatagggaccctgctgcagcagccggatgatcacgctgctacgacatctctttcctggaaacgagtaaaggggtgtaaaagttcagagcaaaatggtatggaacaaaagaccataatcctcattccctccgacctggcatgtaggctcctcggccagtccatggatgagtccgggttaccccagctcacctcttatgattgcgaggttaacgctccaatccaggggtctagaaacctcttacagggcgaggagctcctgagagccctggatcaggtgaac

SEQ ID NO: 33117 - DNA, 2478 bp, Artificial Sequence
  Description of Artificial Sequence: Synthetic coding sequence
atggagggagctggaggtgccaacgacaagaagaagatctccagcgaacggcgaaaagagaagagtcgcgatgccgcccggtcgcgtcgatccaaagagtccgaggtcttttacgaactggcccaccagcttcctctccctcacaacgtgtctagccatctcgataaagctagcgtgatgaggctgacaatttcctacttgcgggtgagaaaactcttagatgccggcgacttggatattgaagacgacatgaaagcccagatgaattgtttttatctgaaggccctggatggcttcgtgatggtgctaacagacgacggagacatgatctatatctcagataacgtgaacaagtatatggggttgacacagtttgagctgaccgggcactctgtctttgactttacccatccctgtgaccacgaagaaatgcgcgaaatgctgacgcatcggaacgggttggtgaaaaaaggcaaggagcaaaacactcaacgttcatttttcctgagaatgaaatgtacattgacttcaagaggtaggacgatgaatataaaatcagcgacgtggaaggtgctccactgcacgggacacatccacgtttacgacaccaatagcaaccagccccagtgcggatacaaaaagccaccaatgacatgtctggtcctgatttgtgaaccaatcccacatcctagtaacatcgagattccattagatagtaagacattcctaagcaggcacagtctcgacatgaagttttcctactgtgatgagcggataaccgagctgatgggctacgagcccgaggagctgctgggtcggtctatctatgagtattatcacgctttggacagcgaccatctgactaaaacccatcacgatatgttcaccaaaggccaggtgaccacaggacagtatcggatgttagccaagcgaggcggctatgtgtgggtggagacccaggccaccgtgatttacaacaccaaaaatagtcagcctcagtgcatcgtctgtgtgaactacgtggtcagtggcatcattcaacacgatctgatcttctcactccagcaaacagaatgtgttctgaagcccgttgaaagctctgacatgaagatgacccagctttttaccaaggtcgagagcgaggacacttccagcttatttgataagcttaaaaaagaacccgatgcgttgacgctcctcgcacccgctgccggggacaccattatttctcttgactttggctccaatgataccgaaactgacgaccagcagctggaagaggttcccctgtacaacgatgtaatgctgcctagccccaatgagaagctgcagaacatcaacttagccatgagtccactgcctaccgctgaaacacctaaaccactgaggtcctctgcagaccccgccttaaaccaggaggtcgcgctgaaacttgaaccgaatcccgagagcctggagctatcctttactatgcctcaaattcaggaccagacgccctcgccttctgacgggagcaccaggcagtccagcccggagccaaatagccctagtgaatactgtttctatgtcgactctgacatggtaaacgagtttaaacttgagctcgtcgagaagctcttcgctgaggatactgaagccaagaaccctttttccactcaggataccgacctggacctggaaatgctggccccctacattccaatggacgacgatttccaactccgctcattcgatcaactatctcccctcgagtcctcctccgcctccccagaaagcgctagcccacagagcaccgttaccgtgttccaacagacacagatccaagagccaaccgcaaatgcgaccaccaccaccgctaccacagacgagctgaaaactgtaacaaaggacagaatggaggacattaaaatacttatcgcgagtccaagcccaacccacattcacaaggaaaccacatccgcgaccagctcgccttaccgtgacactcagtctcgcactgcatcccctaacagagcaggcaaaggcgtgatagaacagactgagaagtctcacccgcgcagtcccaacgtcctaagtgttgctttgtcccagcggaccacggtgcccgaggaggagctgaatccaaagattctggcccttcaaaatgctcagcgcaagaggaaaatggagcacgatggttccctattccaggccgtgggtatcggtactctcctgcaacaaccagacgaccatgcagctacgacctctttgagctggaaaagggttaagggatgcaaaagttccgaacaaaatggtatggagcagaagacaataattttgatccccagcgacctcgcttgcagactgctgggccagagcatggacgaatccggcctcccccaactgacgtcctatgactgcgaggtgaatgcccctattcaaggtagcagaaacctcctgcagggtgaggagctactgcgagcgctggaccaggtgaac

SEQ ID NO: 33118 - DNA, 2478 bp, Artificial Sequence
  Description of Artificial Sequence: Synthetic coding sequence
atggaaggcgctgggggtgctaacgataaaaaaaaaatttcatcagaacgtcgaaaagaaaaatcacgggatgccgctcgatcgcgccgcagcaaggaatccgaggtattctacgagctggcacaccagcttcctcttccgcataacgtgtcttctcatttagacaaagccagtgtgatgagattaactatttcgtaccttagggtgaggaagcttctggatgccggcgatctggatatcgaagatgatatgaaagcacagatgaattgcttctatctgaaggcacttgatggtttcgtgatggtgcttacggatgatggagatatgatttatatctctgataatgtaaataaatatatgggtttaacccaattcgaactcacagggcattcagtatttgattttacacacccgtgcgaccatgaagaaatgcgcgagatgcttactcatcggaacggactcgtgaaaaaggggaaagaacagaacacgcaacgcagtttttttttgagaatgaagtgcacactgacaagcagaggacgtacaatgaatatcaaaagtgcaacatggaaggtgcttcattgtacgggacatattcacgtttacgatactaattcgaatcagccgcagtgtggctataaaaagccgccgatgacgtgccttgtgctcatctgcgaaccgataccccacccgtcaaacattgaaataccgttagactcaaaaacattcctttcgaggcattcgttggatatgaaattcagctactgcgatgagaggatcacagaactgatgggctatgaaccggaagagttacttggacggtcgatttatgaatactatcatgcattagattccgatcatctcacgaaaactcatcatgacatgtttaccaaaggccaggtcacaactggccagtataggatgttggcgaaaagaggtggttatgtgtgggtagaaacacaggctaccgtcatctataatacaaaaaactctcagccacagtgtatagtgtgtgtgaactatgttgtttctggcattatccaacatgatctgatctttagcttgcagcaaaccgaatgtgtgctgaaacctgtggagtcatctgatatgaaaatgacacaattgtttacgaaggtggaatccgaggatacgagttctctttttgacaaactgaaaaaagagcctgatgcattgacgttgttggcaccggcagcgggcgatacaatcatcagccttgactttggcagcaacgacacggagacagatgaccaacaactggaagaggtcccgttatacaatgacgttatgttgccgtccccaaacgagaagctccaaaatataaatctagcaatgagcccgcttcctacggcggagacacctaagccccttagaagttctgcagatccagcgttgaatcaagaagtcgcgctgaagttagagcccaatcctgaaagtctcgagcttagctttaccatgccccagattcaggatcaaacaccgagtccgagtgatgggtcaacccgccagtcgtctccggagcctaactcgcctagcgagtattgcttttatgtcgatagtgacatggttaatgaatttaaactggaactcgtcgaaaaattattcgctgaagatactgaggctaaaaacccgttctcgacacaggatacagatctggatcttgaaatgctggccccgtatattccaatggacgatgacttccagcttcgctctttcgatcaattaagtccattagagtcttccagtgcgagcccggagtccgcatccccgcagtcaaccgttacagtgttccagcaaacgcaaatccaagaaccgacggctaacgccactaccacgacggctacaaccgatgagttaaaaacggtgaccaaagatcgcatggaagatattaagatccttattgctagtccgagtccaacccatattcataaagaaacaacatctgcgacatctagtccgtatcgagatacgcagtcaagaacagcctctccgaacagagcaggtaaaggcgtaatcgaacaaacagaaaagtcacacccacgttcccccaatgttcttagtgttgccttatcccagcggactacagtgccagaggaagaactcaatccgaaaatacttgcgttacaaaatgcgcaacgaaaacggaagatggaacatgatggcagtctgttccaagctgtaggcattggcacgctccttcaacagcctgatgatcatgctgctacgacatctctgtcatggaaaagggttaaaggctgcaagtcatcagaacaaaacggaatggaacagaaaacaatcatcttaattcctagcgacttagcatgtcggttattaggccaatcaatggatgaatctggcttgcctcaattgacgtcctatgactgcgaagttaatgcaccgattcaaggatcacgcaatcttttacaaggagaagaattgttgcgtgcactcgaccaagtgaac

SEQ ID NO: 33119 - DNA, 2478 bp, Artificial Sequence
  Description of Artificial Sequence: Synthetic coding sequence
atggaaggagccggtggtgctaacgacaagaagaagattagcagtgagcggcggaaagaaaaatctcgcgacgccgctcgcagccggcgcagcaaggagagcgaagtcttctacgagttggcacatcagctacccctgccccataatgtgtcatctcatttggacaaggcctcagtgatgagattgactatctcctatttgcgagttcgaaagcttctcgatgcgggagaccttgacattgaagacgatatgaaagcccagatgaactgtttctacttgaaagcattggacggcttcgtcatggtgctgacagacgacggagacatgatatatatttctgataatgttaataagtatatgggactgacacaatttgaactgacagggcattctgtgtttgattttacccacccgtgtgaccacgaggaaatgcgggagatgctaactcataggaatggattagtgaaaaagggcaaggagcagaacacccagaggtctttttttctcagaatgaagtgcacattgacaagcagaggccgcaccatgaatatcaaatcagccacctggaaagtgctccactgcaccggccacatccacgtgtacgacaccaattccaaccagccacaatgcgggtataagaagccccctatgacatgtttagtgctgatctgcgagcccatcccccacccctctaatattgagataccactagatagcaagacctttctgagtcgtcactctctcgatatgaagttctcctactgcgacgaaaggatcactgagctgatgggatatgagcccgaagagctgctcggcaggagcatctacgagtattaccacgcactcgacagcgatcacttgactaagactcaccatgacatgttcactaagggacaggtaacgacgggacaatatcgcatgcttgcaaaacggggaggctacgtgtgggtggagacccaggcaacagttatttataataccaaaaatagccaaccccagtgcatcgtttgcgtcaactatgtggtgtctgggatcatccagcatgacttgatcttcagcctgcagcagacggagtgtgtgctgaaacccgtcgagagctccgacatgaaaatgacccagctcttcactaaggtcgagagcgaggatactagctcactctttgataagcttaagaaggaaccagacgccctgactctactagccccagccgccggggacaccataatttctctcgatttcggctctaacgacacggagaccgacgaccagcagctggaggaagttccgctgtacaacgacgtcatgctaccaagtccaaacgagaaactgcagaatatcaatcttgcaatgtccccccttcccacggcagagactccgaagcctctgaggtcttccgcagacccagctttaaaccaggaagtggccttgaagcttgagcctaacccagagtccctggagctaagcttcactatgcctcagattcaagaccagactccatctccttctgatggttccacccgacaatcaagccccgagccgaactctccctctgagtattgcttctacgtcgattcggacatggtcaatgagtttaagctcgagttggtggagaagctgttcgcagaggacacagaggcaaagaacccattctctacccaggatactgacctcgacctggagatgctggctccctatatccccatggacgatgactttcaactcagaagcttcgatcaactatctcccttggagagctcttcggccagtccagagtctgctagcccgcagtctactgtaacagtctttcagcagacccagattcaggagccaacagcaaacgctaccaccaccaccgccactactgacgagttgaagactgtcactaaagataggatggaagacatcaagattcttattgccagtccgagccctacacacattcataaggagactacttcagctacgtcgtctccctaccgagacacacagtctcgcacagcaagccccaacagagctggaaagggcgttatcgagcagacagagaaatcacaccctcggtctcccaatgttctctccgtggctttgagccagcgtacgactgtgcctgaggaagaactaaatcccaaaattctcgccctgcagaacgcacagaggaagcggaagatggaacacgatgggtctctattccaggccgtggggattggaacactacttcaacaaccagacgatcacgctgctactacatctctcagttggaaaagggtgaagggctgcaaatctagtgaacagaatggcatggagcagaaaaccataatactgataccgagtgatcttgcttgccggctgctcgggcaatctatggatgaaagcggcctgccccaactgaccagctatgattgcgaggtgaatgctcccattcagggcagtcgaaacctcctccaaggagaggagttactccgggccctggaccaggtgaat

SEQ ID NO: 33120 - DNA, 2478 bp, Artificial Sequence
  Description of Artificial Sequence: Synthetic coding sequence
atggagggagcaggtggtgctaacgacaagaagaaaatctcctcggagagacggaaggaaaagagccgggacgccgcaagatcccggcgcagcaaggaaagcgaggtgttttacgagctggcccaccagcttccactgccgcacaatgtgtcatcacacttggacaaagcatcggtgatgcggttgaccatctcctacctccgggtccgcaagctgctggatgccggagatctcgacatcgaagatgacatgaaggctcagatgaattgcttctatcttaaggccctggatggattcgtcatggtgctgaccgatgacggcgatatgatctacatctccgataacgtgaataagtacatgggattgactcagtttgaactcaccgggcacagcgtgttcgatttcacccacccatgcgatcacgaagagatgcgggagatgctgactcatcggaatggtctggtcaagaagggcaaggagcaaaatacccagaggtcattctttctccgcatgaagtgcacgctgacctctcgcggtcggacgatgaacattaagagcgccacttggaaagtcttgcattgcactgggcatatccacgtctacgacaccaacagcaaccagccgcaatgcggatacaagaagcccccgatgacctgcctcgtcctgatctgtgagccaatccctcacccgtcgaacatcgagatccctttggattcaaaaacgttcctgtctcgccacagcctcgatatgaagttcagctactgcgatgaaagaatcaccgagttgatgggatacgagcctgaggaactgctggggcgcagcatctacgagtactaccacgcactcgactcggaccatctgactaaaacccaccacgacatgtttactaagggacaggtgaccaccggacagtaccgcatgctggccaagagaggaggctacgtctgggtcgaaacccaggctaccgtgatctacaacactaaaaactctcagccacaatgcatcgtgtgcgtcaactacgtggtgtcagggatcatccaacacgatctgatcttttcattgcaacagaccgaatgtgtgctcaagccagtggaaagcagcgacatgaagatgacccaactcttcactaaagtggaatcggaggacacctcaagcctgttcgacaaacttaagaaggagccggatgcactgacgctgctggctccggcagctggcgacacgattatcagcctggacttcggttccaacgataccgaaaccgacgaccagcagctcgaggaagtgccgctgtacaatgacgtcatgcttccctcgccgaacgaaaaactgcagaatatcaacctggcgatgtcccctctgccaactgcagagactccgaagccgttgcggtccagcgcagatccagccttgaatcaggaggtggctcttaagctcgagccgaacccggaatcactggagctgtcgttcaccatgccccagatccaggaccagaccccgtcgccgagcgatggatcaacgcggcagagcagccctgaaccgaactcgccttcggaatactgtttttacgtggactcagatatggtgaacgagttcaagttggagctggtggaaaagctctttgcggaagatactgaagctaagaatcccttcagcactcaggataccgatctcgatctggaaatgcttgcgccgtacatcccgatggacgacgatttccagctgaggtccttcgaccaactgtccccgctggagtcctcttccgcgtccccggagtccgccagccctcagagcactgtgacggtgttccaacagacccaaatccaagagccgactgctaacgcaactactactaccgcaaccaccgacgaactgaaaaccgtcactaaggatcgcatggaggacatcaagatcctcatcgcctcaccgtcaccgactcacattcacaaggaaactacttccgcgacctcaagcccgtacagagacacccagtcgcggactgcatcccctaatcgcgccggaaagggagtgatagaacagaccgagaagtcacaccctcggagccctaacgtcctttcagtcgccctgtcccagcgcactactgtgccagaagaggagctgaatcctaaaatcctcgctctccagaatgcccagcggaagagaaagatggagcacgacggttcgctcttccaagcggtgggcatcggcactctgctgcaacaacctgacgaccatgcggcgaccacttcgctgtcgtggaagagagtaaagggatgcaaaagctcggagcagaacggaatggagcaaaagactattatcctgattccgtcggacctggcttgcaggctcctgggacaatcgatggacgaatccggactgccacagctgacctcctacgactgcgaggtgaacgccccgatccagggtagcaggaacctgctgcagggcgaggagctgctgcgggctcttgaccaggtgaac

SEQ ID NO: 33121 - DNA, 2478 bp, Artificial Sequence
  Description of Artificial Sequence: Synthetic coding sequence
atggaaggggcaggcggcgctaacgacaagaaaaaaatctccagtgagagacgcaaggaaaagagccgcgatgctgccagatcccgacggagcaaggagtctgaggtgttctacgaactcgcgcatcagttgcccctgccacataatgtaagtagtcatctggacaaggccagcgtgatgagacttaccatttcatacctgagggtaagaaaattgctggatgcgggggacctggatatcgaagacgacatgaaggctcagatgaactgtttttacctcaaggccctggatggcttcgttatggttttgactgatgatggcgacatgatctacatttcagacaatgtgaataagtatatggggctgacacaatttgagctgaccggccacagcgtattcgactttacacatccatgtgaccacgaggagatgcgagagatgctgacccacaggaacggactggtgaaaaagggcaaggaacaaaacacacaaagaagctttttcctgcgcatgaagtgcactctgacttcccgggggaggacaatgaacataaagagcgccacatggaaagtgttgcactgcaccggccacattcatgtttacgacacaaactctaaccagccccagtgcggatacaagaagccaccgatgacctgccttgttcttatctgtgagccaattcctcatccgtctaacatcgaaataccactggattccaagacgttcctcagccggcattcacttgatatgaaattcagttattgcgatgaaaggatcacggaacttatgggctacgagcccgaagagctgctgggtagaagtatatatgagtactaccatgcccttgatagtgaccatctcactaagacccatcatgacatgttcacgaagggacaggtgactacggggcagtatagaatgctggccaagagaggtggttacgtgtgggttgagactcaagcaacagtgatttacaacaccaaaaacagccaaccacaatgcatcgtctgcgttaactatgtggtgtctggcattatacagcacgacctgattttctcactgcaacagacagaatgcgtgttgaaacctgtggagtcaagtgacatgaaaatgacccagctcttcaccaaggtggagagtgaggatacatcatctctgttcgataaactcaaaaaggagcctgatgccttgactctgctggcacccgccgccggagacacaatcatatccctcgatttcggctctaacgatacagagactgacgatcagcagctggaggaggtgcctctctacaatgacgtgatgctgccgagcccgaacgagaaactccaaaatattaatctcgcaatgtcccctctgcccactgcagaaacacccaaacctctgagatcatctgcggaccctgccctcaatcaggaagttgctctgaagctggaacccaaccctgaatccctggaactttcctttaccatgccccagattcaggatcagaccccctctccctctgatggctctactcgccagagttcacctgaacccaactcccccagtgaatactgtttctacgtagattctgacatggtaaatgagttcaagcttgagctggtggagaagcttttcgcggaagacaccgaggccaagaatccttttagcacccaggacactgatctggacctggagatgctggctccctacattcctatggatgatgacttccaattgaggtctttcgaccagctgagtcctctcgagtccagttcagctagccccgaatctgcctccccacaatcaaccgtcaccgtgttccaacagacccagattcaggagccaacagcaaacgccactactactaccgcaaccacagatgagcttaagacagttaccaaggatcgaatggaggacatcaaaatattgattgccagcccaagtccgacacacatccataaggagacaacttccgctacatcatcaccgtacagagacacccagagtcgcaccgccagtccaaatagggcgggaaagggagtgatcgagcaaacagaaaagagccacccacgatccccaaacgtgctcagcgtcgctctgtcccagcgaaccacagtacccgaagaggagctgaatccaaagatcctggcgctccagaatgctcaaagaaaacgcaagatggaacacgatggttcactgtttcaggcagtagggatcggcaccttgctccaacagcccgacgatcacgccgcaacaacctccctgagctggaagcgggtaaaaggttgtaagtcctcagagcagaacggtatggagcagaagaccataatcttgatcccttctgaccttgcctgtcggctgttggggcagagcatggatgagtcaggtctgccccagctgacttcctacgactgcgaagtcaacgcccctatccagggatctaggaacctgttgcaaggcgaagagctgctccgagcccttgatcaggtgaac

SEQ ID NO: 33122 - DNA, 2478 bp, Artificial Sequence
  Description of Artificial Sequence: Synthetic coding sequence
atggaaggcgctggtggggccaatgataagaagaagatttccagcgagagacggaaggagaaaagcagagacgccgcacggtcgcggagatccaaggagagcgaagtcttttacgaactggctcatcagttgccactcccgcataatgtctcgtcccatcttgacaaagcctcggttatgcggctcaccatcagctacctgcgcgtgcgcaagctgctcgacgctggtgatctggacatcgaagatgatatgaaggcacaaatgaactgcttttacctcaaggcccttgatggtttcgtgatggtgctgaccgacgatggagacatgatctatatctcggacaacgtgaataagtacatgggactgacccagttcgaactcaccggacactcagtctttgacttcactcacccttgcgaccacgaagagatgcgggaaatgcttacgcaccggaatggactcgtgaaaaaggggaaagaacagaacactcaacggagcttttttctccggatgaagtgcactttgacttcaagaggccggaccatgaacattaagagcgcgacctggaaagtgctgcattgtaccggtcacatccatgtgtatgacactaatagcaaccagccacagtgcggatacaagaagccgcctatgacgtgcctggtcctcatttgtgaaccgattccgcacccgagcaatatcgagatacctctggacagcaagaccttcctctcgcgccactcgctcgatatgaagttcagctattgcgacgaacgaatcactgagctgatgggatacgaacccgaggaactgctcggaagatccatctacgagtattaccatgccctggactcagatcacctcactaaaactcatcatgacatgttcaccaagggtcaagtgactacgggacagtacagaatgctcgccaagcggggcggttacgtgtgggtggaaacccaggccactgtcatctacaacactaagaattcccagccgcaatgtatcgtctgcgtcaattacgttgtgagcggaatcatccagcacgatctgattttctccctccagcagactgaatgcgtgctgaagccggtggagtcgtcggacatgaaaatgacccagctgttcactaaagtggagtcggaggacacctcatccctgttcgacaagttgaagaaggaaccggacgcccttactctgctggcccctgccgcgggagacacgatcatttcgctggatttcggcagcaatgacactgaaactgatgaccaacagctcgaagaggttcctttgtacaacgatgtgatgctcccaagcccgaacgaaaaactgcagaacatcaatttggccatgagcccactcccaactgccgagactcctaaaccgctgagatcgagcgccgacccggcgttgaaccaggaagtggcactgaagctggaaccaaatccagaaagcctggagctctcattcaccatgccgcaaattcaagatcagactccttccccgtcggatggatcgactaggcaatcgtccccggaaccgaactccccgtccgaatactgcttttacgtcgactcggacatggtgaacgagttcaaactggagttggtggagaagctgttcgccgaggatactgaagccaaaaatcctttctcaacccaggacaccgacctcgatctggagatgctcgcaccatacatccccatggacgacgacttccaactgagatccttcgaccagctgagcccgcttgaatcgtcctcagctagcccggaatccgctagccctcagagcacggtcactgtctttcaacaaacgcagatccaagaacctaccgcaaatgccactactacgaccgccaccacggatgaactgaaaaccgtgactaaagatcgcatggaggacatcaagattctcatcgcctccccgtccccgacccacatccacaaggaaactacttcggctacttcctctccatacagggatactcagagccgcacggcgtctcctaaccgcgcaggaaagggcgtgatcgaacagaccgaaaagtctcaccctcggtcgccgaatgtcctgtccgtggccctgtcgcagaggactactgtgcctgaagaggagcttaatccgaagatcctggcactccaaaacgcacagcggaagcgtaagatggagcatgatggatcgctgttccaggctgtgggtatcggaaccctgttgcaacaaccagacgatcatgccgcaacgacttcccttagctggaaaagagtgaaaggttgcaagtcgtcagaacaaaatggcatggagcaaaagactatcatcctgatcccatccgatctcgcctgtaggctgctgggacagagtatggacgaaagcggacttccacagctgacttcctacgactgcgaagtgaacgccccaatccagggatcccggaacctgcttcagggcgaagagctgctgagagcactcgaccaagtgaac

SEQ ID NO: 33123 - DNA, 2478 bp, Artificial Sequence
  Description of Artificial Sequence: Synthetic coding sequence
atggaaggcgctggcggggctaacgacaagaaaaagatctctagcgagcggagaaaggaaaagtctcgcgacgctgccaggtcacgccgtagcaaggagagtgaggttttctacgagctcgcccatcagctccctctccctcacaatgtgagcagccacctagacaaggcctcggtgatgcggctcactatttcctatttgcgagtgagaaagctactcgatgcaggcgacctggatatcgaggatgacatgaaggcccagatgaactgcttctacctaaaggctttggatggtttcgttatggttttaaccgatgacggtgatatgatctacatcagtgacaatgtcaacaagtacatgggcctaacccaattcgagcttacgggccacagtgtctttgatttcacccacccatgcgatcacgaggagatgagagaaatgctgacccatcgtaacgggctcgtcaagaagggcaaggagcagaacacccagcgtagtttcttcctacggatgaaatgtaccttgacatctcgcgggcgtaccatgaacatcaagtcggccacctggaaggtgctccactgcactgggcacatccacgtgtacgacaccaactctaaccagccccagtgcggctacaagaagcctcccatgacctgtctcgttttgatctgtgagcccattccccacccttcgaacatcgagattcccctggattcgaagacctttctgagccggcactcgctggatatgaagttctcctactgcgacgagcgtatcaccgagctcatgggttacgagcctgaggagttgctgggccggtctatctatgagtactaccacgctctggacagcgatcacctgacgaagacgcatcacgacatgtttaccaagggacaagtcactaccggccagtaccgcatgttggctaagcgggggggttacgtctgggtagagacccaggctaccgtcatctataacaccaagaattcccaaccgcagtgtattgtttgcgtgaactacgtggtcagcggtatcatccagcacgacctcatcttctcgcttcagcagaccgagtgtgtgctaaagcccgtggagtcgagcgatatgaagatgacacagctctttaccaaggttgagagtgaggacacctcgtcccttttcgacaagctgaagaaggagcccgatgcactcacacttttggccccagccgccggagacaccatcatctcccttgacttcggatccaacgatacagaaacggatgaccagcaactggaggaagtgcccctctacaacgatgtcatgcttccttccccgaacgagaagcttcagaacatcaacctcgccatgtcaccgttgcccaccgccgagaccccaaagcctctgcgtagtagcgctgatcccgccctcaaccaggaggttgccttgaaactcgaacccaaccccgaatctctggaactgtccttcaccatgccacagatccaggaccagactccttcgccgtccgatggatccacgcgtcaatccagccccgagccgaattcgccgtccgagtactgcttctatgtcgactcggatatggtcaacgagtttaagctcgagctggtggagaagttgtttgcagaagacaccgaggccaagaatcccttcagtactcaggataccgatctcgatctggagatgctggccccctacatccctatggacgacgattttcagctgcggtccttcgaccaactgtctcctctggagtctagctccgcatccccggagtctgcgagccctcaaagcacggttaccgtctttcagcagacgcagatccaggagcctaccgccaacgccacgaccaccacagccaccaccgatgagctgaagaccgtcactaaggaccgcatggaggatatcaagatcctgattgcctccccctctcctacccacatccacaaggaaaccacctcggctacgtccagcccgtaccgtgacactcagagcaggaccgccagccctaaccgcgctgggaagggtgtcatcgagcagacagagaagtcccatcctcgctcgcccaacgtcctcagcgtggcgctctcgcagcgaaccaccgtcccagaggaggagctcaaccccaagatcctggccctgcagaacgctcagcgcaagcgtaagatggaacacgacggatcccttttccaggctgttggtatcgggaccctgctccagcagcctgacgaccacgccgccaccacgtccctgagctggaagcgcgtgaagggctgcaagagttcggagcaaaacggcatggaacaaaagaccatcatcctgatcccctcggatctcgcgtgccgcctgcttggacagtcgatggatgagtcggggctgccccagttaacgtcctacgactgcgaagtgaacgcacccatccagggcagcaggaatttgctgcagggtgaagagctgctgagggcactggatcaagtcaac

SEQ ID NO: 33124 - DNA, 2478 bp, Artificial Sequence
  Description of Artificial Sequence: Synthetic coding sequence
atggaaggtgcaggtggtgccaacgacaaaaagaagatttcgtccgaacgccgcaaggaaaagtcccgcgacgcagcgcggtcaagacgatcgaaggaaagcgaagtgttctacgaactggcgcatcagctgcctctgccacataatgtcagctcacaccttgataaggcatccgtgatgcggctgactatctcctatcttcgagtgaggaagctccttgacgccggggatttggacattgaagatgatatgaaagcacagatgaattgtttttacctgaaggcgttggatggttttgtgatggtgcttacggacgacggcgatatgatctacatctcggacaatgtgaataagtacatgggcctgacccaattcgagcttactggtcattcagtctttgactttacccatccatgcgatcacgaggagatgagggaaatgcttacccatagaaatggcctggtcaaaaagggcaaggaacaaaacactcaaaggtcgttctttctgcggatgaaatgtactctgaccagcagaggtcggacgatgaatatcaagtctgcaacgtggaaagtccttcattgtacgggccatattcatgtctatgatactaattcaaaccagccccagtgcgggtacaagaagcctccaatgacttgtttggtgcttatctgtgagcccatcccccatccctcaaacatcgaaatcccacttgattccaagactttcctgagcaggcactccctggatatgaagttctcctactgtgatgaacgaatcaccgagcttatgggatacgaacccgaagaactgctgggaagatcgatttacgaatactaccatgcccttgactcggaccatctcaccaaaacccaccacgatatgtttacgaaaggccaagtgactaccggtcaatatagaatgctggctaaacgtggtggatacgtgtgggtcgaaacccaggcaactgtgatttacaatacgaaaaactcgcaaccccagtgcatcgtgtgtgtaaactacgtggtttctggaataatccaacacgatctgattttctcgttgcaacagacggaatgtgtcctgaagcccgtcgagtcgagcgatatgaaaatgacccagctcttcactaaggtcgagtcggaagatactagctcgctgtttgacaagctgaagaaggagccggacgcacttacgctgttggctcctgcagcaggcgatactattatctcgctggattttggatccaatgatactgagactgacgaccaacaacttgaagaagtgccgctttacaatgacgtgatgctgccttctcccaatgaaaagctgcagaacattaatctcgccatgtcaccattgccaactgcggaaactcccaagccccttcgttcaagtgctgaccctgccctgaaccaggaggtggctcttaaactggagcctaaccctgaatcgttggaactttcgtttactatgccccagattcaagaccaaactcctagcccaagcgatggttccactagacaatcctcaccagaaccaaactcgccgtccgaatactgtttctacgtcgattcagatatggtcaacgagtttaagttggagctggtggaaaagttgttcgccgaggacaccgaagcaaagaaccctttttcgacccaggacaccgacctggacctggagatgctcgcaccatacattcctatggacgatgactttcagttgcgctccttcgatcagctctcgcctctggaaagctctagcgcatccccagagtcagcatcccctcagtcaaccgtgacggtgtttcagcagactcaaattcaagagcccaccgcaaacgctaccacgactaccgcaacgaccgacgaactgaaaactgtgactaaggatcgtatggaggacattaagattttgattgcttcgccatccccaactcacattcataaggaaactaccagcgccaccagctcaccgtacagggatacccagagcagaaccgcatccccaaaccgggccgggaagggtgtgattgagcaaaccgagaaaagccatcctcggtccccgaacgtgctttcggtcgccctttcgcaacgtactaccgtgccagaagaagaactgaacccaaagattttggcgctccaaaatgcacaaaggaaaagaaagatggagcacgatggttccctctttcaagcggtgggtattgggaccctgcttcaacagcctgatgatcatgcggccaccactagcctgagctggaagagagtgaaaggttgtaagagctcagaacagaacggtatggaacaaaagaccatcatacttattccttcggatctcgcatgcagattgcttggtcagtcaatggacgagtcaggacttccccaactgacctcatacgattgtgaggtgaacgctcctattcaaggaagccggaaccttttgcaaggggaggagctgctgcgcgcgctggaccaggtgaac

SEQ ID NO: 33125 - DNA, 2478 bp, Artificial Sequence
  Description of Artificial Sequence: Synthetic coding sequence
atggaaggggcaggcggggctaatgacaagaagaaaatttctagtgaacgtagaaaggagaaaagtagagacgcggcacgcagcagacgaagtaaagaaagtgaggtgttctatgagttagcccaccagctccccctacctcataacgtatcttcacatctcgataaagcgtctgtgatgcggttaactatcagctacttgagagtgcgaaaactactggatgctggtgaccttgatattgaggacgacatgaaggcccaaatgaactgtttctatctgaaagctttggatgggttcgtgatggtgcttactgatgatggcgatatgatctatatctctgataatgtcaataaatatatgggactgacccagtttgagcttactggccactctgtatttgacttcactcacccgtgtgatcatgaggagatgcgtgagatgctaacacaccgtaatggtctggttaaaaaaggcaaagaacagaacacccagcgtagtttctttctgaggatgaaatgtactctcacgtcccggggccgtacgatgaacattaagagcgcaacctggaaggtcctgcactgtacaggtcatatacacgtttacgatactaattctaatcaaccccagtgcggctacaagaagcctcctatgacatgcttggtcctgatttgcgaaccaattccccacccttcaaacatagaaattcctctcgattccaagactttcctcagcagacacagcctggatatgaagtttagttactgcgacgaaagaatcaccgagcttatggggtacgagccggaggagcttctgggtagatctatttatgaatattatcatgctctagactcggaccatctgacaaagactcatcacgatatgttcactaaaggccaggtgacaacaggacaataccgtatgttggctaagagaggagggtacgtgtgggtcgaaactcaggctaccgtgatctataacacaaaaaacagtcagcctcaatgcatcgtctgcgtgaattatgtggtgagtgggatcatacagcatgatctgatcttttctctgcaacagaccgaatgcgtgcttaagccagttgaaagctctgacatgaagatgacacagctctttaccaaggttgagagtgaagacacctcgagcctgttcgataaactcaagaaggagcctgacgcccttacattgttagcccctgctgcgggtgacaccatcatctccctcgactttgggtccaacgacaccgagacggatgaccagcagctcgaagaggtacctttatataacgacgtgatgttgccatccccaaatgagaaattacagaatatcaacctcgccatgagtccactgcctacagcggagacacctaagcctttacgaagctctgccgacccagcattaaatcaggaggtggcactcaaattggaacccaaccccgagagcctggagctatccttcaccatgccccagatccaggatcagaccccatctccctctgatggctccacccggcagtctagcccagaacccaactcaccctcagaatactgcttctatgtcgatagcgacatggtgaacgagtttaagctggagctggtggagaagctattcgcggaagacaccgaggcaaagaaccccttctcgacgcaggacacagacctggatctcgagatgttggctccgtatatccccatggacgatgactttcagcttagaagcttcgatcaactttctccgttggagtcctcctccgccagtccagaatccgcctctcctcagtctaccgtaacagtcttccagcagacccagatccaggagcctactgccaacgccaccacaaccaccgctaccactgatgagctcaaaactgtgaccaaagacaggatggaagatatcaagatcctgatcgcctctccgtctccaacccacatccacaaagagacaaccagcgctacttcaagtccttaccgagatactcagtcaaggaccgcgtctcctaaccgcgctggtaagggggtcatagagcaaacagagaagtcccacccccgctcccctaatgtgctctctgttgccctgtcacaaaggactactgtgccggaagaagagcttaatccaaaaattctggctctgcagaatgctcagaggaagaggaagatggagcacgatgggtcactgtttcaggcagtgggtataggcactttgcttcagcagccggatgaccatgccgcgacaactagtctgtcctggaagcgggtaaagggctgtaagtcatcagaacaaaacgggatggaacagaaaacgattatattgattccttccgacctggcatgcaggttgctgggccaatcaatggatgagtctggcctccctcagctaacgagttatgattgcgaggtcaacgccccgatacaggggtcccggaatttacttcaaggggaagaactgctccgggccttggatcaggtgaac

SEQ ID NO: 33126 - DNA, 2478 bp, Artificial Sequence
  Description of Artificial Sequence: Synthetic coding sequence
atggagggagctggcggagccaacgacaaaaagaagatctcctccgagcggaggaaggagaagtcacgcgacgcagcgagatcaagacgcagtaaggagtcggaagtgttctacgaactggcacatcagctcccgctccctcataatgtctcctcacacctggacaaggcatcagtgatgcggctgacgatcagctacctgcgcgtccggaaactgctggatgccggagatctggacattgaggacgatatgaaggcccaaatgaactgcttctacctcaaggcgcttgacggattcgtcatggtgctcaccgatgatggggacatgatttacatcagcgataacgtcaacaagtacatggggctcacccagttcgagctgactggccactccgtgttcgatttcacgcacccgtgcgatcatgaagagatgcgtgagatgctgacgcaccggaacggactggtgaagaaaggcaaggagcaaaacactcagaggtcgttctttctgagaatgaagtgcaccttgacctcgcggggacggactatgaacataaagtcagcgacttggaaagtgttgcattgcaccggacatatccacgtgtatgacactaactcgaatcaaccgcaatgcggatacaaaaagccgccgatgacctgtttggtgctgatttgcgagcctatcccacatccgagcaatatcgagatcccactggacagcaaaacctttctctcgcggcacagcctggatatgaagttcagctactgcgacgaacggatcaccgaactgatgggctacgagccggaagagctgctgggacgctcgatctacgagtactaccacgcgctggacagcgatcaccttaccaaaacccaccacgatatgtttactaaaggccaagtgactactggtcagtaccggatgctggcgaaacgcggaggatatgtctgggtggaaacccaggcgaccgtgatctacaatactaaaaactcacagcctcaatgcatcgtctgcgtgaattacgtcgtctccggcatcatccagcacgaccttatcttctccttgcagcaaacggaatgtgtcctgaagcctgtcgagtccagcgatatgaagatgacccagctgttcactaaagtggaatccgaggacacctcttcgctctttgacaaactgaaaaaggaaccggatgcccttaccctcctggcccctgccgccggagacacgatcatttccctcgatttcggatccaatgacaccgagactgacgaccaacagctggaggaagtgcccctttacaacgatgtgatgttgccttcgccaaacgagaagctccaaaacatcaacctggccatgtcaccgctgccaaccgccgaaacccccaagccgctgagatcctctgctgacccagccttgaaccaggaggtggcactgaaactggagccgaaccccgaatccctcgagttgagcttcaccatgccacaaattcaggatcaaacgccatccccttcggacggctcgaccagacagtcctcgcccgagcccaattcgccgagcgaatactgtttctacgtggactccgatatggtgaatgagtttaagctggaattggtcgagaaactcttcgcagaggataccgaagcaaagaacccgttctctactcaagacacggatcttgacttggaaatgctggccccatacatcccgatggacgacgatttccagctgagatcgttcgaccagctctcgccactggaatcctcaagcgcatcaccggagagcgcatctccccagtcgactgtcaccgtgttccagcagacccaaattcaggaaccgactgccaacgccacgaccaccaccgcaactaccgatgaacttaagaccgtgaccaaagaccgcatggaggatatcaagattctgatcgcatctccctcacctacccacattcacaaggagactacctcagcgacctcgtcgccctaccgcgatactcagagccggaccgcctcgcctaaccgcgccgggaaaggtgtgatcgaacagactgagaagtcccaccctcgcagcccgaacgtcctctccgtggccctttcgcagcggaccacggtgccggaggaagaactgaacccgaagattctcgcgctgcagaacgcccaaagaaaacgcaagatggaacatgacggatcactgtttcaagccgtcggcatcggcaccctccttcagcagccagatgatcacgcagcaaccacctcgttgagctggaagcgggtgaaaggctgcaagtcatcagagcaaaatggaatggaacaaaagaccattattctgatcccatcggacctggcctgccggctgctcggccaatccatggatgaatccggattgcctcagctgacctcatacgactgcgaggtgaatgctcccatccagggatcgcggaacctccttcagggagaggagctcttgcgagcgctcgaccaagtcaac

SEQ ID NO: 33127 - DNA, 2478 bp, Artificial Sequence
  Description of Artificial Sequence: Synthetic coding sequence
atggagggcgcaggaggcgctaatgataaaaagaagatcagctcggagcgccgcaaagagaagtctcgggatgcagcccgaagcaggagatcaaaagaatcagaggtgttctacgaacttgcgcaccagttaccgttaccccataatgtgtcaagtcatctggataaagcttctgtaatgaggttaaccatttcatatctgcgcgtccgaaagctcttggatgcaggcgatctcgatatcgaagacgacatgaaggcccagatgaattgtttttatcttaaagcgctggacggctttgtgatggttttgaccgacgacggtgacatgatttacatctccgataacgtgaacaagtatatgggcctgactcagtttgaattgaccggtcacagtgtttttgactttacccatccctgtgaccacgaggagatgagggagatgttgactcacagaaacggtctggtgaaaaaaggcaaggagcagaatactcagcgatccttcttcctgagaatgaaatgcactctcaccagccgaggccgcactatgaatatcaagagcgccacttggaaagtgctccactgtaccggccatatacacgtgtacgatacaaacagcaaccaaccccagtgcggctacaagaagcccccgatgacctgtttggtactgatatgtgagcctatacctcatccttctaacatcgagatccctcttgactccaaaacattcctctcccgccactcacttgacatgaagttcagctactgcgacgagcgaatcacggagctcatgggctatgagccggaagagctactgggccggtccatttatgagtactaccacgctttggattcggaccacctgactaaaactcatcatgatatgtttacaaaagggcaggtgactactgggcaatatcgaatgctggctaaaagaggagggtacgtttgggtggaaacccaggccacggttatatataacactaaaaatagccagcctcaatgtattgtgtgcgtgaattacgtggtgagtggcataatacagcacgatttaatcttttcactgcagcagaccgaatgtgtgcttaagcccgtggaatctagcgacatgaaaatgactcagctgtttactaaagtagaatccgaggacaccagctcccttttcgacaagctcaagaaggagccagacgctctgaccctgttggcgcctgcagccggagacaccatcatatccctagacttcgggtcaaacgacactgagacagatgaccagcagctagaagaggtaccactatacaatgacgtaatgctgccctcacccaacgagaaactccaaaacatcaatttggctatgtcacccctgcctaccgccgaaacccccaaaccgctccgaagttccgccgatcccgcccttaatcaagaggtagctctcaaactggagcccaacccagagtcactggaactgagcttcacgatgccccagatccaggatcagaccccatctccatctgatgggtctacacggcagtcatcacccgaaccaaatagcccaagtgaatattgtttttatgtggacagtgacatggtcaatgaatttaaactggaactagtggagaagctcttcgcagaggacactgaggccaaaaatcctttcagtactcaagacactgatctggatcttgagatgctggcgccgtacattcctatggacgatgactttcagttacggagtttcgaccagctcagcccactggaatctagcagcgcgtcgccagaaagcgcaagtccacagtcgacagtcaccgtcttccagcaaacacagatacaggaacccaccgctaatgccactaccacgaccgcaacgaccgacgagctgaagaccgtcaccaaagatcgtatggaagatatcaagatccttatcgcctcccccagccccacgcatatacacaaggaaacgacctccgctacctcctccccctatcgggatactcaatcaagaacggcgagtccaaaccgcgcgggaaaaggtgtgatcgaacagacagagaaaagtcaccctaggtctcctaatgtacttagtgtagcactgtcccagcgcacaaccgtgccagaagaagaattaaatcccaagattctggctttgcaaaacgcccagaggaagaggaagatggaacatgacggctcactattccaggccgtgggcattggtactcttctgcagcagccagacgatcatgcggccacaacctctctgtcttggaagcgcgtgaaagggtgcaagtccagcgagcaaaacggaatggagcagaagacaatcattctgattccttccgacctcgcttgccgactgctgggccaaagtatggacgagtctgggcttcctcaattaacaagttatgactgtgaggtgaacgcccccatccagggatcgcggaatttactgcagggagaggaactcctccgcgccctagatcaggtgaac

SEQ ID NO: 33128 - DNA, 2478 bp, Artificial Sequence
  Description of Artificial Sequence: Synthetic coding sequence
atggagggagctggtggggcaaacgacaagaaaaagatttcaagcgagcgaaggaaggagaaatcgcgcgatgccgcaagatcccgtagatccaaggagtcggaagtgttttatgaactggcccaccagcttcccctgccacacaatgtgtcgagtcacctggataaagcgtccgtaatgagactcacgatttcttatttacgggtgagaaagttgctcgacgcaggcgaccttgacatcgaggacgatatgaaagcgcagatgaactgtttctatctgaaagctctagacggctttgttatggtgctgacagacgatggcgatatgatatatattagcgataatgtgaacaagtacatggggctgactcagttcgaactcacaggacactctgtgtttgacttcacgcacccctgtgaccacgaggaaatgagggagatgttaacccacagaaatggcctggtcaaaaaaggcaaggagcagaatacacagcgcagcttcttcctcagaatgaaatgtacactcacttctcgggggagaactatgaatattaaatctgcaacctggaaagttcttcattgcacaggccacatacacgtatacgacaccaatagcaatcagcctcagtgtggttataagaagccccctatgacatgccttgtgctcatctgcgagcctatcccacacccaagcaatatagaaatccccctggattccaagaccttcttatcacggcactccctggatatgaaattcagttattgcgacgagcggattacagaacttatgggctacgagccagaggagctgctaggtcgaagcatatacgaatactatcacgccctcgactctgaccacctgacaaagacgcaccacgatatgtttacaaagggacaggtcacaacgggacagtaccgaatgctcgcaaagaggggcggttatgtgtgggtggagacacaggcaacagttatctataataccaaaaactcgcaaccacagtgtatcgtgtgcgtgaattacgtagtttctggcattattcagcacgatctgatattctctctgcagcaaactgagtgcgtcctcaagcccgtagagagctcggatatgaaaatgactcagctctttacgaaggttgaatcagaggacacgtccagcttgttcgataagctgaagaaggagcctgatgcactgacactgctcgctcctgcggccggagacaccattatctcgctcgatttcggatccaacgacactgagactgacgatcagcagcttgaggaggtgcctctatacaatgatgtgatgctgccaagcccaaatgaaaaactccaaaacatcaatctggcgatgtcccccctccctaccgcggagacccccaagcccctccgatccagtgcagatccggctctgaaccaggaagttgccctcaagctcgagcccaatccagagtcactggagctgagctttaccatgccacaaattcaggaccagacccccagtccttcagacgggagcacgagacagagctcgcctgaaccaaattccccctccgagtactgcttctatgtcgacagcgacatggtgaatgagtttaaactggagctggtggaaaagctgtttgcagaggacacagaggccaagaatcccttctcaactcaagatactgaccttgacttagagatgctcgccccttacatcccaatggatgacgattttcagctgcggtcattcgatcagttgtcccccctggaatcttcctcggctagcccggagtcagcctccccacagagcaccgtcaccgtgtttcaacaaacccagattcaggaacctacagccaacgccacaacgacaactgctacaactgacgagctgaaaaccgtcacaaaagatcgtatggaagatattaaaattttgatcgcctcccccagtcccacacacattcacaaggaaacaacgtcagctacttcttcaccctaccgcgacacacagtctcgaacagctagcccaaacagagccgggaaaggtgtgattgaacagacggagaaatctcatccgcgaagtcctaacgttttatctgtcgcattaagtcagcgcaccacagtcccagaggaagaactgaacccaaagatcctcgctcttcagaacgctcaaaggaaacgcaagatggaacacgacggctctctgtttcaagctgtcggaattggtaccttgttgcagcaaccagacgatcacgccgctactacctctttgtcctggaagcgagtgaagggctgcaagtctagcgagcagaatggtatggaacaaaagacaattatccttatcccaagcgacttggcctgcaggctcctgggccagtccatggacgaatccggactccctcagctgacaagctacgactgcgaagtgaacgcccccatacagggttcgcgaaatctcctccagggcgaggagttactaagggcactggatcaggtgaat

SEQ ID NO: 33129 - DNA, 2478 bp, Artificial Sequence
  Description of Artificial Sequence: Synthetic coding sequence
atggaaggggccggaggcgcgaatgataagaaaaagatttcgtctgagcgccggaaggaaaagtcaagagacgcagcacgtagccgccgctcgaaggaatctgaagtcttttatgaactcgcgcatcaactcccactgcctcacaatgtgtcgtcccacctcgacaaggcctcagtcatgaggcttaccatatcgtaccttcgggtccgtaaacttctcgacgcaggcgatctcgacattgaagatgatatgaaggcgcaaatgaattgcttttatcttaaagcacttgacggatttgttatggtgttgaccgacgatggagacatgatttacatttctgataacgtgaataagtacatgggactgacgcagtttgagctgaccgggcatagcgtctttgattttacccatccatgcgaccatgaagaaatgcgagagatgcttactcaccgaaacggtctggtgaagaagggaaaagaacaaaatacgcaacggagcttttttcttaggatgaagtgcactcttacctcccgaggtcggaccatgaacataaagtcggctacttggaaggtcctccattgtactggacacatacatgtctacgatacgaatagcaaccagccgcaatgtggatacaaaaagccccctatgacctgtctcgtgctgatttgtgaacctatcccacatccttccaacattgaaatccccctggactccaaaacgttcctgtccagacattcccttgacatgaagttttcgtactgcgacgaaagaataactgagctgatgggttacgaacctgaagaacttcttgggcgttccatctacgagtactaccatgcccttgattccgatcacctcactaagactcatcatgatatgtttaccaagggacaagtgacgaccggtcagtatcgaatgctggcgaaacggggtggttacgtgtgggtggaaactcaagcaactgtgatttacaacaccaagaattcgcagcctcaatgtattgtatgcgtcaattacgtggtgtcgggcataattcagcacgacctgattttcagcctgcaacaaactgaatgtgtgttgaagcccgtggagtcatcggacatgaagatgactcaactgtttaccaaagtcgaatctgaagatacttcatcactctttgataaactcaagaaggagccagatgcacttactctgcttgccccggcggcgggagatactatcatttcactggatttcggtagcaatgatacggaaaccgacgatcagcagcttgaggaggtccctctgtacaacgatgtcatgctgccgtcgccgaacgagaaattgcaaaacatcaacctggccatgtcgccacttccaactgcggaaaccccaaagcctcttaggagctccgccgatcccgccctgaaccaggaggtggcccttaagctcgagcctaacccagaatcgttggagctttcattcactatgcctcaaattcaagaccagaccccttcaccgagcgacggctcgaccagacaaagctcgcccgagcctaactccccaagcgagtattgcttttacgtggattccgatatggtcaacgaattcaagctggagctcgtggaaaaactttttgcagaggacactgaagctaagaacccattctccactcaagataccgatctggaccttgaaatgctggcaccgtacatccctatggatgatgatttccaacttcggagctttgaccagctctcacctcttgagtcatccagtgcttcccctgagtccgcatcgccccagtctactgtgactgtattccaacaaacgcagatccaagaacccaccgctaacgcaactactaccaccgccactaccgatgaactgaaaacggtcaccaaggataggatggaagatatcaaaatactgatcgcaagcccctccccaacccacattcataaggaaactacttcagcaacctcgtcgccatacagagacactcaatcgcgtaccgcttccccaaaccgcgcaggcaagggagtcatcgagcaaacggagaaaagccatccccgctccccaaatgtcctttcggtggctctttcccaacgtaccaccgtgcctgaagaggagctgaacccgaagattcttgcgctgcaaaacgcccagcgaaagagaaagatggaacacgacggatcgcttttccaggccgtaggaatcggcactctgctccagcagccagatgatcacgcggcgaccacctcgctttcatggaagcgtgtgaaaggctgtaagtcctcggaacagaacgggatggaacaaaagactatcatacttattccttcagatctggcatgtcgccttttgggacaaagcatggacgaatccgggttgccacagcttacctcctacgattgtgaagtgaacgcccccattcaagggtccagaaatctgctgcagggagaggaactgcttagggcactggatcaggtgaat

SEQ ID NO: 33130 - DNA, 2478 bp, Artificial Sequence
  Description of Artificial Sequence: Synthetic coding sequence
atggaaggagcaggtggagctaatgataaaaaaaaaatatcaagtgaaagaagaaaagaaaaatctagagatgcagcaagatcacgacgaagtaaagaatctgaagttttttatgagttagctcatcaattaccacttccacataatgtttcgagtcatcttgataaggcatcagttatgcgacttaccatatcatatttaagagtaagaaagttattagatgcaggagatcttgacattgaagatgacatgaaggcacaaatgaactgtttttatttaaaagctttagatggttttgttatggtattaacagatgacggtgatatgatttacattagtgataatgttaataagtatatgggacttacacaattcgaattaaccggacattcagtttttgattttacccatccatgtgatcatgaagaaatgagagaaatgttaacccatagaaatggacttgtcaagaaagggaaagaacaaaatacacaaagaagtttttttcttcgtatgaagtgtacacttacttcaagaggaagaactatgaatatcaaatcagctacatggaaagttttacattgtaccggacacattcatgtctatgatacaaactcaaatcaacctcaatgtggatataagaaaccaccaatgacatgcttagttcttatttgtgaaccaattccacatccttcaaatattgaaattccattagattctaagacctttttaagtcgtcattcattggatatgaaattttcttattgcgatgaaagaattacagaattaatgggatacgaaccagaagagttacttggtagatctatttatgaatactatcatgctcttgattctgatcatcttactaaaacacatcatgatatgtttacaaaaggacaagttactactggacaatatagaatgttggctaaaagaggaggttatgtttgggtagaaactcaagctacagttatttataatacaaaaaattcacaacctcaatgcattgtttgtgtaaattatgttgtttcaggtattattcaacatgatttaattttttctttacaacaaacagaatgtgtccttaaaccagtggaaagtagtgatatgaaaatgacccaattatttacaaaagtagagtcagaagatacttcaagcctttttgataaattaaaaaaagagccagatgctttgactttgcttgcaccagcagcaggtgatactattattagtttagattttggatctaatgatacagaaacagatgaccaacaattagaagaagttccattatataatgatgttatgttaccatcaccaaatgaaaaacttcaaaatattaatttggccatgtcaccattacctactgcagaaactcctaaacctttaagatcttcagcagatccagctttaaatcaagaagttgctttaaaattagaaccaaatccagaatcattagaattatcatttactatgccacaaattcaagatcaaacaccatcaccatcagatggttctactagacaaagttcaccagaaccaaattcaccatcagaatattgtttttatgttgatagtgatatggttaatgaatttaaattagaattagttgaaaagttatttgctgaagatactgaagcaaaaaatccttttagtacacaagatactgatttggatttagaaatgttagcaccttacattcctatggatgatgattttcagttgagatcttttgaccaattatcaccattagaatcttcaagtgcatctccagaatctgcatctcctcaatctactgttactgtatttcagcaaacacaaatccaagaaccaactgcaaatgcaacaaccacaactgctacaacagacgaattaaagacagttacaaaagatagaatggaagatattaaaatccttatcgcaagtccttcaccaactcatattcataaagaaacaacttctgctactagtagtccatatcgtgatacacaaagtcgtacagcttctccaaatagagctggaaaaggagtaattgaacaaaccgaaaaatcacatccaagatcaccaaatgtacttagtgtagctttaagtcaaagaactactgttccagaagaagaattgaatccaaagatattagctcttcaaaatgcacaaagaaaacgtaaaatggaacatgatggttcactttttcaagcagttggtataggtactttattacaacaacctgatgatcatgctgcaacaacttcattatcatggaaaagagtaaagggatgtaaatcaagtgagcaaaatggtatggaacaaaaaacaattattcttataccttctgatttggcttgtcgtttattaggtcaatcaatggatgaatcagggttaccacaacttacttcatatgattgcgaagttaatgctccaatacaaggatctagaaacttattacaaggagaagaacttcttagagcattagatcaagttaac

SEQ ID NO: 33131 - DNA, 2478 bp, Artificial Sequence
  Description of Artificial Sequence: Synthetic coding sequence
atggagggagccggtggtgcaaacgataagaagaaaatctcatccgaaaggcgcaaggaaaagtccagagacgcagcacggtccagaaggtccaaggagtccgaagtgttctacgaactcgcacatcagcttcccctccctcataacgtctcgtcacacctggacaaggcttcggtgatgagactgactatttcgtatcttcgggttagaaaacttttggatgcgggggacctggacatagaagatgatatgaaggcacaaatgaactgcttctaccttaaagccctggacggcttcgtgatggtgctgactgatgatggtgacatgatttacatctcagacaatgtcaataagtacatgggactgacccaatttgaattgaccggtcattccgtgtttgactttactcacccttgtgatcacgaagagatgcgcgaaatgcttacccaccgaaacgggctcgtcaagaagggcaaagaacagaacactcaaagatcgttttttctcagaatgaagtgtaccctgacctcacggggtcgaactatgaacatcaaatccgctacttggaaggtcctgcattgcactggacatattcacgtgtacgatactaattcgaaccaaccacagtgtggatacaaaaaaccgcccatgacctgtctggtgctcatttgtgagccaattcctcatccatctaacattgaaattcctttggatagcaagaccttcctgtcaagacattcactggacatgaaattcagttactgtgatgaaagaatcaccgaactgatgggctacgaacctgaagagctcttgggcagatcgatctacgagtactaccacgcacttgattctgatcatctgaccaaaacccatcacgacatgttcacgaagggacaggtgactaccggccaatacagaatgttggccaagaggggcgggtacgtgtgggtggaaactcaggcaacggtgatttacaatactaagaacagccaacctcagtgtatcgtgtgcgtgaactatgtggtgtcaggcatcattcaacacgatcttatcttcagccttcagcagaccgaatgtgtgcttaaacctgtcgaatcaagtgacatgaagatgacgcaactcttcaccaaagtggagagcgaggacacctcatccctgtttgataaactgaagaaggaacccgatgccctgaccttgcttgcaccagccgctggagacactattatctcgctcgattttggtagtaacgatactgaaaccgatgaccagcagcttgaggaggtgcctctctacaacgacgtgatgcttccatcccccaacgaaaagttgcagaacataaatcttgcaatgagccctttgcctactgcggagactcctaaacctctgaggtcctccgccgacccggcactcaaccaagaagtggctcttaagctcgaaccaaaccccgaatctcttgaactctcgtttaccatgcctcagatacaggatcagacgccgtccccaagcgatggcagcaccagacaatcctcccctgagcccaacagcccttcagaatactgcttctacgtggactcggatatggtgaacgaattcaaactggaactggtggagaagctgttcgccgaagataccgaggcgaaaaacccttttagcactcaagacactgatttggatcttgaaatgctggcgccttacattccaatggatgatgactttcaacttagatcatttgatcagctgtcgccacttgaatcaagctcagcctcgccagaatcagcaagcccccagagcactgtgacggtgtttcaacagacccaaattcaggagccaaccgccaacgccaccaccactactgcaactactgatgagctcaagaccgtcaccaaggatcgcatggaagatatcaagatccttattgcgtctccatcccctactcatattcataaggaaaccactagcgctacgtcgagcccttacagagacacccaatcccggactgcaagccctaaccgcgcgggaaagggggtcattgaacagaccgagaagtcccatccccgatcgccaaacgtgctttccgtcgcactttcgcaacgtaccaccgtccctgaagaagaattgaaccccaagattctcgcacttcagaacgcacaacggaagaggaagatggaacatgatggaagcctcttccaagccgtcgggattggaactcttctgcaacagcctgacgaccatgccgcaactacctccctgagctggaagcgagtcaaaggttgcaaatcttctgagcagaacggaatggaacaaaagacgatcatcctcattccctcggatctcgcgtgtaggcttcttggtcagtcgatggacgaaagcggcttgccacagctcaccagctacgactgtgaagtcaatgcgccgattcaaggttcccggaaccttctgcagggcgaagaactgctcagggcacttgatcaggtgaat

SEQ ID NO: 33132 - DNA, 2478 bp, Artificial Sequence
  Description of Artificial Sequence: Synthetic coding sequence
atggagggcgcaggtggtgctaatgacaaaaaaaagatcagtagcgaacgcagaaaggagaagtcccgcgacgccgccagaagtcgcagatctaaggagtctgaggtgttctacgaactcgcacaccagctccccctgccccacaacgtgagttcccatctcgataaggcctctgtcatgcgtcttaccatctcatatctccgcgtgcgtaagctgctcgatgcaggagatctggacatagaggacgacatgaaagctcagatgaattgcttctacctgaaggcactcgatggcttcgtcatggttctgactgacgacggtgatatgatctacatcagcgacaacgtgaataaatacatgggcctgacccagttcgagctgaccggtcattctgtctttgatttcacccacccctgcgatcacgaggaaatgcgcgaaatgttgacacatcgtaacggcctggttaagaaaggtaaggagcagaacacacagcgctctttctttctcaggatgaaatgtacattgacatccagaggtcgcaccatgaatattaagtccgctacttggaaggttctgcactgcacaggtcacatccacgtgtacgacaccaattcaaaccagcctcagtgcggatataaaaagccccctatgacctgcctcgtgctcatctgcgaacctattccacatccaagtaacatcgagatccctttggactctaagacttttctctctcgtcattccctggacatgaaattctcctactgcgatgagcgtattaccgagttgatgggatatgaacccgaggagctgttgggaaggtccatctatgagtactatcacgcactggattctgatcatctcactaagacacaccatgatatgtttactaagggtcaagtcactaccggccaatataggatgcttgccaagaggggtggctacgtgtgggtggagacccaggccaccgtgatctataacactaagaactcacagcctcagtgtatcgtttgcgtcaattatgtggtttccggtatcatccagcatgatctgatcttctccctgcaacagacagaatgtgtgctgaaacccgtagagtcctctgatatgaagatgacccagctctttacaaaagtcgaatccgaagatacttcaagcctttttgataagctcaagaaagagcctgacgcccttacattgttggctccagcagctggtgacaccatcatcagcctggatttcggctctaatgacaccgaaacagatgaccagcagctcgaggaggtgccattgtacaacgacgttatgctgcccagccccaacgagaagctgcagaatatcaacttggcaatgtccccacttcctacagctgagactcccaagcccttgaggtcctccgccgaccctgcattgaaccaggaagtggctctcaagctcgaacctaatcccgaatcattggagctgagctttaccatgccccaaatccaggaccagaccccctctccaagcgatggatctacccgtcagtctagccctgagcctaactccccctccgagtactgcttctatgtcgacagcgacatggtaaacgagtttaagctggaactcgtcgaaaaactgtttgctgaagataccgaggccaagaatcctttttcaacccaggacacagatctcgacctggagatgcttgccccatacattccaatggacgacgacttccaactcaggtcctttgaccagctgtcccctctggaaagctcatcagcttctcccgagtcagccagtccccaaagcacagtaaccgtgttccagcagacccaaatccaagagcctactgctaatgcaactaccacaaccgccaccactgatgagctgaagacagtcacaaaggatcgtatggaggatataaagatacttatagccagcccctctcctactcacattcataaagaaacaacctccgctacttccagcccttatcgcgacactcagtctagaactgcttccccaaatagggcaggaaagggagttatcgagcagaccgaaaagtcccacccaaggtcccctaacgttctgagcgtcgccttgtcacagagaactactgtccctgaggaagagctgaaccccaagattctcgcactgcaaaacgcccagcgcaagcgtaagatggaacatgatggttcacttttccaggctgtgggtatcggcaccttgctccagcagcctgatgatcatgctgccacaacaagcctgtcctggaagcgcgtcaaaggctgcaagagttcagagcagaacggcatggagcagaagactataatccttatcccctcagatctcgcctgtaggctgctgggtcagtcaatggacgagagtggacttccccagcttacatcttatgactgcgaggtgaatgcccctatccagggtagccgtaatctcctgcagggagaggaacttctccgcgcattggatcaggttaat

SEQ ID NO: 33133 - DNA, 2478 bp, Artificial Sequence
  Description of Artificial Sequence: Synthetic coding sequence
atggagggggccgggggagccaatgacaaaaagaagatatcaagtgagaggaggaaggaaaaaagccgcgatgccgcccgatcccgacggagcaaggagtcagaggtgttttatgaactggcgcatcaactcccgctgccacataatgtgagtagccatttggacaaggccagtgtaatgcgactaacaatcagctacctccgagtgcgtaagctccttgacgctggggatctggacattgaagacgatatgaaggcccagatgaactgcttctatctgaaggctctcgatggttttgtaatggtgctgaccgacgacggggacatgatttatatttccgataacgttaataagtatatgggcctcacgcagtttgaactgaccgggcatagcgtatttgactttacgcatccgtgcgatcacgaggaaatgcgggagatgttaactcataggaatggactcgttaagaaagggaaggagcagaatacccagcgctccttttttctgcgaatgaaatgtactctaacgtcaaggggtaggacgatgaacatcaaaagtgccacgtggaaggtgttgcattgtacaggccacatccatgtgtatgatactaattcaaaccagcctcaatgtggctacaagaaacctccaatgacctgcttggtcctaatttgtgagcccatcccccaccccagcaatatagagatcccactggatagcaagacttttctttcacgccacagcttagacatgaagttttcatactgcgatgagcggattactgagcttatgggttacgagccagaagaactcttaggccgctccatctacgagtattatcacgcattggatagtgatcatttaacaaaaacgcaccatgacatgtttacaaaaggccaggtcaccactggccaatacagaatgctggctaaaagaggggggtacgtttgggttgagacccaagctaccgtaatctataatactaagaatagtcagccccagtgcatcgtgtgtgtgaattatgtggtgtccggaatcattcagcatgatctgatctttagtctgcagcagacagaatgtgtccttaagccggtcgagagttcagacatgaagatgacccagctcttcaccaaggtagagtccgaggatacttcttcgctcttcgataagttgaaaaaggaaccggatgccttaacgctactggcacccgcagctggcgacacaattatcagtttggatttcgggagtaatgatacagagaccgacgatcagcaactggaagaggttcccttatataatgatgtgatgctgccatctccgaacgaaaagttgcaaaacatcaatttggcaatgagtccactccccacggccgagacgccaaagcccttgaggtccagtgcggatcccgccctaaaccaggaagtggcgttgaagctggagccgaacccggagtcattggagctcagctttacaatgccacagatccaagaccagaccccaagccccagcgatggtagtacaaggcagagttcacccgaaccaaacagcccaagcgagtattgcttttatgtggattccgacatggtgaacgagtttaagctagagctggtagagaagttgttcgctgaggacacggaggccaaaaaccccttttctacacaggatacagatctcgatctcgagatgcttgcaccctacatcccaatggacgatgatttccagctgcggtcctttgatcagttaagccctctggaaagctcttccgccagtccagagtcggcatccccgcagtcaacagtgacagtgttccaacagacgcagatccaggaaccgaccgccaacgccacgacaactacggccacgaccgatgaactgaaaacagtgacaaaggaccggatggaagacatcaaaatcctgattgcatcccccagtcccacccacatccataaagagactacttcagcaacgagctcaccttacagagacactcaatctcgaacagcatctcccaacagggcgggcaaaggggtgatcgagcagacagaaaaatcgcaccctcgcagtccaaacgtactttcagtagctctgtcacagagaacaaccgtgccggaggaagagcttaatcccaaaatcctcgccttgcagaacgctcagagaaaacgcaagatggagcacgatggtagcttattccaagctgtgggcatcggaacactgctgcagcagcctgatgaccacgccgccaccacgtccctatcttggaagagggtcaagggctgcaagtccagcgagcagaatggtatggagcagaagaccattatactgatcccctcggatctggcatgcagactgctgggtcagagcatggatgaatctggcctgccacagctgacttcctacgactgtgaagttaacgcccccatccagggcagtaggaacctcctgcagggcgaagagctactgcgcgccctggatcaggtcaat

SEQ ID NO: 33134 - DNA, 2478 bp, Artificial Sequence
  Description of Artificial Sequence: Synthetic coding sequence
atggagggagccggcggtgccaatgacaaaaagaaaattagctctgagcgccgcaaggagaagagccgggacgcagcacgctcccgacgcagcaaagagagcgaggtcttctacgagcttgctcaccagttgccactgccgcacaacgtctctagccatttggataaggcttcagtgatgcgcctgaccatcagctacttgagggtccgcaagcttttggacgctggcgaccttgatatcgaggacgacatgaaggcccagatgaattgtttctacctcaaggccttagatggcttcgtgatggtcctgacagatgatggcgacatgatttacatctctgacaatgtgaacaagtacatgggccttacgcaattcgaacttactgggcattctgtgttcgattttacccatccatgcgaccatgaagagatgcgggagatgcttacgcatcgaaacggtctcgttaagaaaggcaaggaacaaaatacccaacgcagcttcttcctgcgcatgaagtgtacgttgactagccgcggtcgcaccatgaatatcaaatctgcgacgtggaaagtgttacactgtactggtcatattcacgtttatgataccaactccaatcagccgcagtgtgggtataaaaagccgcctatgacttgtctggttctcatctgcgagccaattcctcacccgagcaatatcgagattcctttagactccaagaccttcctgtcccgtcatagccttgacatgaagttcagctactgcgatgagcgcatcactgaactgatgggttatgaaccagaggagctgctcggccggtccatttacgagtactatcacgcattagactcagatcacctcactaagacgcaccatgatatgtttaccaaagggcaggttactaccggtcaatataggatgttggctaaacgcggtggctacgtgtgggttgagacgcaagcgactgttatttacaacactaaaaattcccagcctcaatgcatcgtatgcgtgaattacgtggtttctggcattatccaacacgatttaattttttcactgcaacaaaccgaatgtgttctgaagccggtggagtccagcgacatgaagatgacccagctgttcacgaaagtggagagtgaagacacttcctccctgtttgataaactgaagaaggaaccagatgcactgaccttgctggcgcctgccgcgggtgacaccattatcagcctggactttggttcgaacgatacggaaactgacgaccagcaactggaggaggtcccactgtacaatgatgtgatgttgccatcccctaatgagaaactgcagaacattaacctcgctatgtccccgcttccaaccgcggaaacaccgaaacctctgagatcaagcgcagaccctgcgctcaaccaagaggttgctctgaagctggaacctaacccagagtccttagaactgagcttcaccatgccgcagatccaagatcagacgcctagtccaagcgacggttccacccgccagagcagcccggaaccgaattctccatcggagtactgtttctatgttgactccgatatggtcaacgaatttaaactggagctggttgagaaactgttcgcggaggacactgaggctaagaacccattcagcacccaagatacggatctcgatctcgaaatgctggcgccttacattcctatggacgacgactttcagctgcgtagcttcgaccagctgtctcctttggagagcagcagcgcatctcctgaaagcgcctcgccacaaagcaccgttactgttttccagcagacccagatccaggagcctaccgctaatgcgactaccactacggccactacggatgaactgaagactgtgacaaaagacaggatggaggacattaagatcctgattgcgtcaccgtcaccaactcacatacataaagaaactacttctgctacgagctcaccttaccgggacactcaatcacgcactgccagcccaaatcgcgccggcaaaggagtcattgagcagaccgagaagagccatccacgctctcctaatgtgctgtcggtcgcactcagtcagcgcaccaccgtgccggaagaggagctgaatccgaaaattttggcgctgcagaacgctcaacgcaagcggaagatggaacatgatggttctctgttccaagcagttggaatcggtaccctgctgcaacagcctgatgatcatgccgctactacgagcttaagctggaagcgtgtgaaaggctgtaagtcctcagaacagaacggtatggagcagaagacgattatccttattccaagcgacctggcctgccgtctcctgggccagagcatggatgagtccgggttgccgcagctgacttcttacgactgcgaagttaatgctccaatccaaggcagccgcaatctactgcaaggagaggaattgctgagagcactggatcaggtgaat

SEQ ID NO: 33135 - DNA, 2478 bp, Artificial Sequence
  Description of Artificial Sequence: Synthetic coding sequence
atggagggggcgggtggagccaatgacaaaaagaaaatctctagcgagcgccggaaggaaaaaagtcgggacgctgccaggtccaggcggtccaaagaaagtgaggtgttttacgagttggcccaccagctccctctgcctcacaatgtgtcgtcccatctagacaaggcatcagtaatgagattaaccatttcgtacctgagagtgcggaaattactcgacgcaggcgacctggatatcgaagacgacatgaaagctcagatgaattgcttttatctgaaagcactggatggttttgtgatggtgttaactgacgatggcgatatgatctacatctcggataacgtcaataagtatatgggcttgacgcagttcgaactgaccggccactcagtgtttgactttactcacccgtgtgaccacgaggagatgcgtgaaatgttgacccatcggaatggcctggtgaaaaaaggtaaagagcagaacacacagcgctctttcttcctacgtatgaaatgcaccctgacctcccgaggcagaaccatgaatatcaaaagcgcaacttggaaggtattgcactgcaccggtcacatacatgtgtatgacaccaattcaaatcaaccccagtgcggttataaaaagccacctatgacttgcttagtgctgatctgcgagcctattcctcacccctctaatattgaaatccccctcgattcaaagacttttctctcaaggcacagtctggacatgaaatttagctactgtgacgagaggattaccgaactgatgggatatgagcccgaagagcttctgggaaggtctatatatgagtactatcacgccctagacagcgatcacctgaccaagacccatcacgacatgtttactaagggtcaggtgacaaccggccagtaccgaatgcttgctaaaaggggcggctacgtgtgggtggagacacaggccacagtgatctacaacaccaaaaactcccagccccagtgtatcgtgtgcgtgaattacgtagtgagtgggatcatccagcacgaccttatttttagcctccagcagactgaatgtgtcctcaaacctgtcgagtcttctgacatgaagatgacgcaactgttcacaaaggtcgagagtgaagatacatccagcttgttcgataaactgaagaaagagccagatgcattgactctgctggcacccgccgcaggagataccataatttctctggattttggttcaaacgacacagagactgacgatcaacagctggaggaggtgccactgtataatgacgtgatgttgccttctcctaacgagaaacttcagaatatcaatctcgcaatgagcccactccccactgctgaaactcctaagcctctgcggagcagcgctgaccccgccctcaaccaagaggtggccctgaaactcgaaccaaatccagaatccctcgaactgtcctttaccatgccccaaatccaagaccaaactccctcgccttccgacggcagtacaagacagagctcgcccgagccgaattctccttctgagtactgcttctatgtggactcagatatggtcaacgaattcaagcttgagctggtagagaagctgttcgctgaggacacagaggccaagaatccgttcagtacgcaggacaccgacctggacctcgagatgctggcaccctacatccccatggacgatgacttccaacttagaagcttcgaccagttgtcgcccttggaatcctcgtccgcttctccggagtcagcctcgccacagagcacagtcaccgtgttccaacagacccagatacaagagccaaccgcaaacgctactactaccaccgccactacggacgaattgaagactgtcaccaaagatagaatggaggatattaaaatcctgattgcaagccccagtccaacacatattcataaggagactacgagcgcaacatctagtccatatagggatactcagtctaggaccgcgtcccctaaccgtgctggcaaaggggtgatcgaacagactgaaaagtcgcatcctcgcagtcctaacgtgctctccgtggctctgagccagcgcacaaccgtgccagaggaagaattgaaccctaagattctggctctacagaatgcacagcgaaagagaaagatggaacatgacggctccctatttcaggcagtggggattgggactctcctgcaacagcctgatgatcacgccgctacaacttctctctcttggaaaagagtgaaaggctgcaagtctagcgagcagaatgggatggagcaaaagactatcatcctgattccatccgatctcgcttgcagactccttggacagtcaatggatgagagcggactgccacagctcacatcatatgattgcgaagtgaacgctcccatccagggatcgcggaacctgctgcagggagaggaactgttgagagctcttgaccaagtgaat

SEQ ID NO: 33136 - DNA, 2478 bp, Artificial Sequence
  Description of Artificial Sequence: Synthetic coding sequence
atggaaggtgcgggtggtgcgaatgataaaaaaaaaatatcgtcggaacgtcgaaaagaaaaatcgcgagatgcggcgcgatcgcgtcgttcgaaagaatcggaagtattttatgaactagcgcatcaactaccgctaccgcataatgtatcgtcgcatttagataaagcgtcggttatgcgattaacgatatcgtatctacgtgtacgtaaattattagatgcgggtgatctagatatagaagatgatatgaaagcgcaaatgaattgtttttatctaaaagcgttagatggttttgttatggtattaacggatgatggtgatatgatatatatatcggataatgtaaataaatatatgggtttaacgcaatttgaattaacgggtcattcggtatttgattttacgcatccgtgtgatcatgaagaaatgcgtgaaatgctaacgcatcgtaatggtttagttaaaaaaggtaaagaacaaaatacgcaacgttcgttttttttacgtatgaaatgtacgctaacgtcgcgaggtcgtacgatgaatataaaatcggcgacgtggaaagtactacattgtacgggtcatatacatgtatatgatacgaattcgaatcaaccgcaatgtggttataaaaaaccgccgatgacgtgtttagtattaatatgtgaaccgataccgcatccgtcgaatatagaaataccgttagattcgaaaacgtttctatcgcgtcattcgttagatatgaaattttcgtattgtgatgaacgtataacggaattaatgggttatgaaccggaagaattattaggtcgatcgatatatgaatattatcatgcgctagattcggatcatctaacgaaaacgcatcatgatatgtttacgaaaggtcaagtaacgacgggtcaatatcgaatgttagcgaaacgaggtggttatgtatgggtagaaacgcaagcgacggttatatataatacgaaaaattcgcaaccgcaatgtatagtatgtgttaattatgtagtatcgggtataatacaacatgatttaatattttcgctacaacaaacggaatgtgttctaaaaccggtagaatcgtcggatatgaaaatgacgcaattatttacgaaagtagaatcggaagatacgtcgtcgctatttgataaattaaaaaaagaaccggatgcgttaacgctactagcgccggcggcgggtgatacgataatatcgttagattttggttcgaatgatacggaaacggatgatcaacaactagaagaagtaccgttatataatgatgttatgctaccgtcgccgaatgaaaaattacaaaatataaatctagcgatgtcgccgctaccgacggcggaaacgccgaaaccgttacgttcgtcggcggatccggcgctaaatcaagaagttgcgctaaaattagaaccgaatccggaatcgttagaattatcgtttacgatgccgcaaatacaagatcaaacgccgtcgccgtcggatggttcgacgcgacaatcgtcgccggaaccgaattcgccgtcggaatattgtttttatgtagattcggatatggtaaatgaatttaaactagaactagtagaaaaactatttgcggaagatacggaagcgaaaaatccgttttcgacgcaagatacggatctagatctagaaatgttagcgccgtatataccgatggatgatgattttcaactacgatcgtttgatcaattatcgccgctagaatcgtcgtcggcgtcgccggaatcggcgtcgccgcaatcgacggtaacggtatttcaacaaacgcaaatacaagaaccgacggcgaatgcgacgacgacgacggcgacgacggatgaactaaaaacggtaacgaaagatcgtatggaagatataaaaatattaatagcgtcgccgtcgccgacgcatatacataaagaaacgacgtcggcgacgtcgtcgccgtatcgagatacgcaatcgcgtacggcgtcgccgaatcgagcgggtaaaggtgtaatagaacaaacggaaaaatcgcatccgcgttcgccgaatgtactatcggtagcgttatcgcaacgtacgacggtaccggaagaagaattaaatccgaaaatactagcgttacaaaatgcgcaacgtaaacgtaaaatggaacatgatggttcgctatttcaagcggttggtataggtacgttactacaacaaccggatgatcatgcggcgacgacgtcgctatcgtggaaacgagttaaaggttgtaaatcgtcggaacaaaatggtatggaacaaaaaacgataatactaataccgtcggatttagcgtgtcgtttattaggtcaatcgatggatgaatcgggtctaccgcaactaacgtcgtatgattgtgaagtaaatgcgccgatacaaggttcgcgtaatctattacaaggtgaagaactattacgagcgctagatcaagttaat

SEQ ID NO: 33137 - DNA, 486 bp, Artificial Sequence
  Description of Artificial Sequence: Synthetic coding sequence
atgcgcatctccaaaccacaccttcggtccatcagcatccagtgctacctgtgcctcctcctgaactcccacttcctgactgaagcgggaatccatgttttcattctgggctgcttctcagcgggactccctaaaactgaagccaattgggtcaatgtgatctcggacctcaagaagattgaagatctgatccaatctatgcatatcgacgccaccctgtacacggagtcggacgtccacccgtcgtgtaaggtcaccgcaatgaaatgttttctcctcgaactgcaggtgatcagcttggagtccggtgacgccagcatccacgatactgtggagaaccttatcatcctggctaataactcactgtcgtcgaacgggaacgtgaccgagagcggatgcaaggaatgcgaggagctggaagaaaagaatatcaaggaatttttgcagtccttcgtgcatatcgtgcaaatgttcattaacacctca

SEQ ID NO: 33138 - DNA, 486 bp, Artificial Sequence
  Description of Artificial Sequence: Synthetic coding sequence
atgaggatctccaaaccgcacctccggagcatttccatacaatgttacctttgtctcctgttgaactcacactttctgaccgaggctggtatccacgtgttcatactgggctgcttctctgctggacttcctaaaaccgaggcaaactgggttaatgtcatctctgacctgaaaaaaatcgaagatctcattcaatcaatgcatatcgacgccactttgtacacagagtccgatgttcacccttcttgcaaggtgacagctatgaaatgttttctgctggaactgcaggtgatttctctggaatccggggacgcctccattcacgataccgtggaaaatcttattattctcgccaacaactctctgtcctccaacggtaatgtgaccgagagcggctgcaaggaatgtgaggagctggaggagaaaaatatcaaagagttcctgcaaagcttcgtgcacattgttcaaatgttcattaacacgagc

SEQ ID NO: 33139 - DNA, 486 bp, Artificial Sequence
  Description of Artificial Sequence: Synthetic coding sequence
atgagaatctccaagccgcatcttcgatcgatctcgatacaatgttatctttgtctgcttcttaactcccacttcctcactgaggcagggattcacgtgtttatccttggatgcttctcggccgggcttcctaagactgaggctaattgggtgaacgtcatctcagatctcaaaaagattgaggatctgatccagagcatgcacatagacgcaactctgtacactgagtcggatgtccatccctcgtgtaaggtgaccgccatgaaatgttttttgctggagcttcaggtgatcagcctggaatcaggcgatgcctcgattcatgatacggtcgaaaacctgattatccttgctaacaattcactgtcctcaaacggcaatgtgacggaatccggttgtaaagaatgcgaagaactggaggagaaaaacataaaggagtttttgcagtcgtttgttcatattgttcaaatgttcattaacacctcc

SEQ ID NO: 33140 - DNA, 486 bp, Artificial Sequence
  Description of Artificial Sequence: Synthetic coding sequence
atgagaatatccaaaccccaccttcgctccatatccattcagtgctatctctgcctattgcttaactcacactttctaactgaagccgggatccacgtatttatattgggatgcttttcagccggactgcccaaaactgaggccaattgggttaacgtgattagtgatctgaaaaaaatcgaggatttaatacagtctatgcacatcgatgcgactttatatacagagtcagatgtgcatcctagttgcaaggtaacagcaatgaaatgtttcctcctcgaacttcaggtaatatctcttgaatcaggggatgcatctatacatgatactgtggaaaatctcattattctagctaacaactcattatcctctaatgggaatgtcacagagtcgggatgtaaagaatgcgaagaactggaagaaaaaaacatcaaagaattcttacagtcttttgtgcacattgtacaaatgtttatcaatacatca

SEQ ID NO: 33141 - DNA, 486 bp, Artificial Sequence
  Description of Artificial Sequence: Synthetic coding sequence
atgaggatatccaaaccccacctgagatctatctccattcagtgttatctgtgcctcttgctgaactcccacttcttaaccgaagccggcatacacgtttttatcctggggtgcttcagtgctggcctacctaagaccgaagctaactgggttaatgtaatctctgatctgaagaagatagaggatctgatccagagtatgcacatcgatgcaaccctgtatactgagtctgatgtccacccgtcatgtaaggtaacagccatgaagtgctttttactggagcttcaggtaatttcactggagtccggggatgcgtccatacacgataccgtggaaaatttgattattctggctaataacagtctttcctcaaacggaaacgtcaccgaatcaggctgcaaggagtgcgaggagcttgaagagaagaatatcaaagaatttctgcagagctttgtccacatcgtgcaaatgttcatcaacaccagc

SEQ ID NO: 33142 - DNA, 486 bp, Artificial Sequence
  Description of Artificial Sequence: Synthetic coding sequence
atgagaatcagcaaaccgcacctccggagcattagcattcaatgttacttgtgtttgctgctcaatagccacttcttgactgaagctggaatccacgtgttcatcctgggctgctttagcgcggggctcccgaaaactgaggccaattgggtaaatgtcatctccgacctgaaaaagatcgaggacctcatccagagcatgcacatcgatgccaccctgtacaccgagagcgacgtgcacccgtcatgtaaagtcaccgcaatgaagtgctttcttctggagctgcaagtgatttcgctcgagtccggagatgcctcgattcatgacactgtcgagaatctcatcattctggccaacaactcactgagctcgaacggtaacgtcactgaatcgggctgcaaggaatgcgaggagctcgaagagaagaacattaaggaattcctgcagtcgtttgtgcatatcgtgcagatgttcatcaatacgtca

SEQ ID NO: 33143 - DNA, 486 bp, Artificial Sequence
  Description of Artificial Sequence: Synthetic coding sequence
atgcgtatttccaaaccacacctacggtccatttccattcaatgctatctgtgtctgctattaaatagtcatttcttaacagaggctggaatccacgtgtttatcttgggctgcttcagcgcggggctgcccaagacagaggccaattgggtaaatgtcatttcagacttgaagaagatcgaggatctgatacaaagcatgcacattgacgctaccttgtatacagagtccgacgtccacccttcctgcaaagttaccgccatgaagtgttttctgttggaattacaggtgattagcctggagagcggagatgcaagtatccacgacaccgtcgagaacctcataattctggcaaataatagcctaagttccaatggtaatgtgacagaatctgggtgcaaggagtgtgaagaattggaagaaaaaaacattaaagagtttctgcagtcctttgttcacatagtgcagatgttcatcaatacgtcg

SEQ ID NO: 33144 - DNA, 486 bp, Artificial Sequence
  Description of Artificial Sequence: Synthetic coding sequence
atgcgcatctcgaagccgcacttgcggtcgatctccatccagtgctacctgtgtctgctgctcaactcgcacttcctgactgaagctggcatacacgtattcatcctcggttgtttctccgcgggactcccaaagactgaagcgaattgggttaacgtgatcagcgacctcaaaaagattgaggacctcatccaaagcatgcacatagacgccacgttgtataccgaatcggatgtgcatccgagctgcaaagtcactgccatgaagtgctttctgctggaactgcaggtcatctcactcgagagcggcgatgcgtcaattcacgacacggtcgagaatctgatcattctggccaataactccctgtcctcaaacgggaatgtgaccgagtcgggctgcaaggagtgcgaagaacttgaagaaaagaacatcaaagagttccttcaatcctttgtgcatatcgtgcagatgttcatcaacacgtcg

SEQ ID NO: 33145 - DNA, 486 bp, Artificial Sequence
  Description of Artificial Sequence: Synthetic coding sequence
atgagaatatcaaagcctcatcttagaagtatttctatacagtgctatctgtgcctactactgaactctcacttcctgacggaggccgggattcacgtcttcattctcggctgcttctctgcaggactgcccaagactgaagcaaattgggttaacgttatcagcgaccttaagaagattgaggatctgatacagagcatgcatatcgatgctacactgtacacggagagcgatgtgcatcccagctgtaaggttaccgccatgaagtgtttcctgttggagctccaagtgatttcactcgagtcgggggacgcatctatccatgatacagtggagaaccttatcatcttggccaacaatagcctctccagtaacggcaatgtcacagaaagcggatgtaaagagtgtgaggagctggaagagaagaacatcaaggagttcctccaatcttttgtgcatatcgtccagatgttcataaacacaagt

SEQ ID NO: 33146 - DNA, 486 bp, Artificial Sequence
  Description of Artificial Sequence: Synthetic coding sequence
atgagaatctcgaagccgcatctgcgctcgatcagcatacagtgctatctgtgcctgctcctgaattcacattttctcaccgaggccgggatccatgtcttcatccttggttgcttctccgctggcctccccaagaccgaagccaactgggtaaacgtgatttctgatctgaagaaaattgaggacctaattcagtcgatgcatatagacgcaacgctctatacggaatccgacgtgcatcctagctgtaaggtaacggccatgaagtgtttcctgttggaactgcaggtcatctctctggagagcggcgacgcctccatccacgatactgtggagaatttgataattcttgctaacaattcacttagttctaatgggaatgtgactgagtctggttgcaaggagtgcgaggaactagaggagaagaacataaaagagtttctgcaatctttcgtgcacatagtgcaaatgttcattaatactagc

SEQ ID NO: 33147 - DNA, 486 bp, Artificial Sequence
  Description of Artificial Sequence: Synthetic coding sequence
atgcgtatcagcaagcctcatctgcgcagcatcagcattcaatgctatctgtgcctgttgttgaatagccatttcctgacggaggccggcattcacgtgtttattttagggtgctttagtgctgggctgcctaaaacagaagccaattgggtcaatgtgatatcagacctgaagaagatagaagacctcatacaatctatgcatattgatgccacgctgtacacagagtcggacgtgcatccatcttgcaaagtcacagccatgaaatgtttcctcctcgaactgcaggtgatctccctagagtcgggcgatgctagcatacatgataccgtagagaatctaattatcctagctaacaactcgctttcaagtaacggtaatgtgactgaatctggatgcaaggagtgcgaggagttagaagagaaaaacatcaaggagttcttgcagagtttcgtccacatagtccaaatgttcatcaacaccagc

SEQ ID NO: 33148 - DNA, 486 bp, Artificial Sequence
  Description of Artificial Sequence: Synthetic coding sequence
atgaggattagcaaacctcaccttcgttccatctcgattcagtgttacttgtgccttttgctgaattcccattttcttactgaggccggcattcacgtgttcatccttggatgtttctcggccggtttgcctaagaccgaagcaaactgggtgaacgtcatctcggacctgaagaagatcgaagatctcatacagtcaatgcatatagatgccaccttgtacactgaatcggatgtgcacccatcctgtaaagtgactgcaatgaaatgttttctgctggagctgcaagtgatttcccttgaatccggtgatgcgagcattcacgacaccgtggaaaatctcattatcctggcgaacaactcactgtcgagcaacggtaatgtgaccgagtcgggttgtaaggaatgcgaggagcttgaagaaaagaacattaaggagttcctccagtcttttgttcatatcgtgcagatgttcatcaatacctcg

SEQ ID NO: 33149 - DNA, 486 bp, Artificial Sequence
  Description of Artificial Sequence: Synthetic coding sequence
atgcggattagtaagccacatctgaggtccatttctatccaatgctacctatgcctgctactgaactcacattttttaactgaggccggcatccacgtcttcattctcgggtgcttttcggccggactgcctaagaccgaggccaattgggtaaatgttattagtgatttgaagaaaatcgaggacctcatacagagcatgcacatcgacgcgaccctttatacggagtctgacgtgcatccttcttgcaaggtgaccgcaatgaagtgtttcctcctcgaactccaggtgatctccctcgaaagcggtgacgcatctatccacgatacagtcgagaatctgatcattctggcgaataacagtcttagttcgaatggaaatgtgaccgagtctggttgtaaggagtgtgaagaacttgaagagaagaacatcaaagagttcctccaaagtttcgtgcacattgtacaaatgttcattaacaccagc

SEQ ID NO: 33150 - DNA, 486 bp, Artificial Sequence
  Description of Artificial Sequence: Synthetic coding sequence
atgaggataagcaagccgcatttgagaagtatatcaattcagtgctacctctgcctgctcctcaatagccactttcttactgaggctggaattcacgtctttattctaggctgtttctccgcaggattaccaaagactgaagctaactgggtgaacgtcatcagtgacctgaagaaaatcgaagacctgatacagtcaatgcacattgacgccaccctgtacacagagagtgatgtccatcctagctgcaaggttactgctatgaagtgttttctcctggagctgcaggtgatctcccttgaatccggagatgccagtatccatgacaccgtcgagaatctgattatactggccaacaactctctttccagcaacggcaacgttactgagtcaggttgtaaggagtgcgaggagttggaggagaaaaacatcaaggagtttctgcagtcatttgttcacattgtacagatgtttattaatactagc

SEQ ID NO: 33151 - DNA, 486 bp, Artificial Sequence
  Description of Artificial Sequence: Synthetic coding sequence
atgcgaatttccaaaccacacctgcggtctataagtattcagtgttacttgtgtctgctccttaacagccacttcttgacagaggctggtattcatgtctttattctgggatgcttctcagcaggcctgcccaagacagaagctaactgggtcaatgttatctccgacttgaaaaaaattgaggacctgatacagagcatgcacattgatgccaccctctatactgaatccgatgtacatccatcatgtaaagtaactgcaatgaagtgctttctgctcgagttgcaggtgatcagcttggagtctggggacgcctctatccatgacacagtagagaatctgatcatcctggctaacaatagtctcagttctaacggaaacgtgaccgagtctggatgtaaagagtgtgaggaactggaggagaaaaacatcaaagagttcctgcagtcctttgttcacattgtccagatgtttatcaacacgtct

SEQ ID NO: 33152 - DNA, 486 bp, Artificial Sequence
  Description of Artificial Sequence: Synthetic coding sequence
atgcggatcagtaagcctcatttaaggtctatctccatccaatgttatctttgcctgttgttgaactcccattttttgactgaggccgggatccacgtcttcatccttgggtgcttttccgcaggcttacctaagaccgaggctaattgggtgaacgtgatctcagatctcaaaaaaatcgaagatctgatccagtcgatgcatatcgacgcgactctctacaccgagtccgacgttcacccatcctgtaaggtgaccgcaatgaaatgctttttgttagaacttcaggtgattagccttgaatcaggggatgcatcaattcacgacacggtggaaaatctcatcatccttgctaacaacagcctgagctcaaacggcaacgtgaccgagtccggttgcaaagagtgtgaggagttggaagagaagaatattaaagaatttttgcagtccttcgtgcacatcgtccagatgttcatcaacaccagc

SEQ ID NO: 33153 - DNA, 486 bp, Artificial Sequence
  Description of Artificial Sequence: Synthetic coding sequence
atgcggattagcaaaccacatcttcggagcatcagcatccagtgctacctttgcctgctcctgaattcgcacttcttgaccgaggccggaatccacgtgttcatcttgggatgcttcagcgcaggtttgcctaagacggaagcgaactgggttaacgtcatcagcgatctgaagaagatcgaggacctgatccaatcaatgcacatagatgcgaccctgtacactgaatcagatgtgcacccgtcctgtaaggtcaccgccatgaaatgcttcctccttgagctgcaggtgatctcactggaatcgggagatgcgtcaatccatgacacggtggaaaatctgattatcctcgcaaacaatagcctgagctccaacgggaacgttacggagtcgggctgcaaggaatgcgaggagctcgaggaaaagaacattaaggagttcctgcaatcctttgtgcatatcgtccagatgttcataaacacttcg

SEQ ID NO: 33154 - DNA, 486 bp, Artificial Sequence
  Description of Artificial Sequence: Synthetic coding sequence
atgcggatctccaagccgcacttgaggtcgatatccatccagtgctacttgtgcctcctgctaaactcgcatttcttgactgaggccggcatacatgtgttcatccttggctgtttcagtgccggcctgcccaagaccgaagcaaactgggttaacgtgatcagcgacttaaagaagatcgaggatctcattcaaagtatgcatatcgatgccaccttatataccgaaagcgacgttcatccctcatgcaaagttacagcgatgaagtgcttcctgctggagctgcaggttatctccctggaatcgggggacgcctcgatccacgacactgtcgagaatctgatcatcctcgcgaacaactccctcagctcaaacggaaacgtgacagaatcaggatgcaaagagtgtgaagagctggaagagaagaacattaaggagtttctacagtcttttgttcacatcgttcagatgttcatcaatacctcc

SEQ ID NO: 33155 - DNA, 486 bp, Artificial Sequence
  Description of Artificial Sequence: Synthetic coding sequence
atgcggataagcaagcctcatttgcgctctatttcaattcaatgctacctctgtttactccttaatagccattttttaactgaggccggcattcacgtgtttatactggggtgcttttccgctggactgcctaaaactgaggctaactgggtcaatgttattagtgaccttaagaagattgaggatctgatacaaagtatgcacatcgatgccaccctgtatactgaatcagacgttcatccgtcttgtaaagtgactgctatgaaatgcttccttttggaattgcaggtcatctctctggagtccggggatgcatctatacatgataccgttgaaaatctgattattttggcgaataattccttgtctagtaatggtaacgtcacggaaagtggttgtaaggaatgcgaagagctcgaagaaaagaatattaaggagttccttcaatccttcgttcatattgttcaaatgtttattaatacttct

SEQ ID NO: 33156 - DNA, 486 bp, Artificial Sequence
  Description of Artificial Sequence: Synthetic coding sequence
atgcggatctccaagccacatttgcgaagtatatcaatccagtgctacctgtgcctgctgctcaatagccatttcttgactgaagcaggaatacacgtattcatacttggatgcttttctgcagggcttcccaagaccgaagccaactgggtaaacgtcatctctgatctgaagaaaatagaggacttgatccagtctatgcacatcgatgcgacattgtacaccgagtccgatgtgcaccctagctgtaaagtgaccgctatgaagtgctttctgctggaactccaggttatttcacttgaatcgggtgacgccagcatacacgacacagtcgagaatctcattatattggctaataacagcctgtcatcaaacgggaatgtcacagagtcaggctgtaaggagtgcgaggagcttgaagaaaaaaacattaaggagttcttacagtcgtttgtacacatagttcagatgttcattaatacttcc

SEQ ID NO: 33157 - DNA, 486 bp, Artificial Sequence
  Description of Artificial Sequence: Synthetic coding sequence
atgaggatttcaaagccacacctgcggtccatcagcatacaatgttacctttgcctcttactgaacagtcactttttaacagaggcagggattcatgtttttatcctgggatgtttctccgctggcctgcccaaaactgaggctaactgggtgaacgtgatttcggacctcaagaagattgaagacctgatccaatccatgcatatcgacgccaccttgtataccgaatccgacgtccaccctagctgtaaggtcactgccatgaaatgtttcctcctagagttacaggtgatcagccttgagagcggcgatgctagcattcatgacaccgtggaaaatctgatcattctcgccaataactctctcagcagtaatgggaacgtgacagaaagcggttgcaaagaatgcgaggaactggaagaaaagaatatcaaggaatttcttcagtcattcgtgcatatcgtccagatgtttattaatacaagc

SEQ ID NO: 33158 - DNA, 486 bp, Artificial Sequence
  Description of Artificial Sequence: Synthetic coding sequence
atgaggatatctaagccacacctacgcagtatatctattcagtgctacctatgcctgctcttgaacagccactttttgaccgaagccggtatccacgtgttcatactcgggtgtttctcggccggcttacctaagacagaagccaactgggtgaacgtgatctcagatttaaaaaaaattgaggatctcatccagtctatgcacatagatgccacactctacacagagtctgatgtccacccatcctgtaaagtcactgccatgaagtgttttctgctggagctgcaagtgatctcgctagagtctggagatgcatcaatccatgacacagtcgagaatctgattatcttagcaaataattccctgagttcaaatggcaacgtgacagaatcaggttgcaaggagtgtgaggagctcgaggaaaaaaacatcaaggaattcctgcagagcttcgtacatattgtacagatgtttattaatacctct

SEQ ID NO: 33159 - DNA, 486 bp, Artificial Sequence
  Description of Artificial Sequence: Synthetic coding sequence
atgaggatttccaaaccacatcttagatcgatctcaatccagtgctacctgtgccttctgctgaacagtcatttccttaccgaggcgggaatacacgtgttcatcctcggatgtttctcggcagggctgcccaaaaccgaagccaattgggtgaacgtgatcagcgatctgaagaagatcgaggacctgatccagtcgatgcacatcgatgcgactttgtacacggaatcagacgtgcacccgagctgcaaggtcactgcgatgaagtgtttcctccttgaactgcaagtaatatccctcgagtctggtgacgcctcgatccatgacactgttgaaaacctgatcattctcgctaacaactcattgtcctcaaacggcaatgtgaccgaatcaggctgcaaggagtgcgaagaacttgaagagaagaacatcaaggagtttttgcagagcttcgtgcacatcgtgcaaatgtttatcaataccagc

SEQ ID NO: 33160 - DNA, 486 bp, Artificial Sequence; identical to SEQ ID NO: 33158
  Description of Artificial Sequence: Synthetic coding sequence

SEQ ID NO: 33161 - DNA, 486 bp, Artificial Sequence
  Description of Artificial Sequence: Synthetic coding sequence
atgcgcatttccaaaccacatctccggtcaataagcatacagtgttacctctgccttctgcttaattcgcactttcttaccgaagcaggcattcatgtgtttatcttggggtgtttttcagctggcctgccaaaaaccgaggccaactgggtgaacgtgatctcagacctgaagaaaattgaagatctcatccaatcgatgcatatagacgcaaccctttacactgaaagcgatgtgcacccatcctgcaaagttaccgctatgaagtgttttcttcttgaacttcaggtcatttcgcttgagtcgggagacgcatccattcacgataccgtcgaaaacctgatcattttggccaacaactctctctcatcaaatggtaacgtcaccgagtcgggctgtaaggagtgcgaagaactggaagaaaagaacataaaggagttcctccagtcctttgtgcatattgtccaaatgtttatcaatacgtcc

SEQ ID NO: 33162 - DNA, 486 bp, Artificial Sequence
  Description of Artificial Sequence: Synthetic coding sequence
atgcgtatcagcaagccacatctgaggagtatcagtatccagtgctatctctgcctgctcttgaactcccacttcctgacggaagccggcattcacgtgttcattctgggctgctttagtgctggccttcccaagaccgaggcgaactgggtgaacgtcatttctgacttgaagaaaattgaggatctgatccaaagcatgcacatagacgccaccctgtatacggagtccgacgtacatccatcctgcaaagtcaccgctatgaagtgcttcctcctcgagctacaagtgatttctctcgagagtggtgatgccagcatccatgacaccgtcgaaaatctcatcatcctggcgaataactcgctgtcgtccaacggcaacgtcaccgagagcggttgtaaggaatgcgaagagctcgaggaaaagaacattaaggaattccttcagtccttcgtccacatagtacaaatgttcataaacaccagc

SEQ ID NO: 33163 - DNA, 486 bp, Artificial Sequence
  Description of Artificial Sequence: Synthetic coding sequence
atgagaatttccaagcctcacctgcggtcgatttccattcaatgctacctctgccttctgttgaactcccatttcttgacggaggcaggtatacacgtctttatcctcggatgcttttccgcaggactccctaagaccgaggccaattgggtgaatgtgatctcagacttgaaaaagattgaggacctgattcagtcgatgcatatcgatgcaactctgtacaccgagtcggatgtgcatccatcctgtaaagtcacggcaatgaaatgttttcttttggaactgcaagtgatttcacttgaatccggggacgcaagcatccatgataccgtggagaacctgattatactcgcgaacaactcgctgtcgagcaacggaaacgtcactgagtccggctgtaaggagtgcgaggaattggaagagaagaatatcaaagaattcctgcaatcttttgtgcatatagttcaaatgttcatcaacacctcc

SEQ ID NO: 33164 - DNA, 486 bp, Artificial Sequence
  Description of Artificial Sequence: Synthetic coding sequence
atgagaatatccaaacctcacctgagatcaatctcgatccagtgttacctttgtctcctgcttaattcgcactttctgactgaagcaggtattcatgtgttcattcttgggtgtttttcagcaggactcccaaaaacggaagccaactgggtgaatgtcatctcggacctgaagaagatcgaggatctgatccaatctatgcatattgatgccactctttacaccgaaagcgacgtgcacccatcgtgcaaggtcactgcaatgaagtgtttcttgctcgaattgcaggtgatctccctcgagtcgggtgatgcatcaattcatgatacggtcgagaatttgattattcttgcaaacaattcgcttagctccaacggtaacgtcaccgaatcgggctgcaaggaatgtgaagaactggaagagaagaacatcaaggaatttcttcaaagttttgtgcatatcgtgcaaatgttcatcaacactagc

SEQ ID NO: 33165 - DNA, 486 bp, Artificial Sequence
  Description of Artificial Sequence: Synthetic coding sequence
atgcggatcagcaagcctcacctgcgctcgatctccatacaatgttacctttgtctcctgctgaactcccatttccttaccgaagctgggattcatgtctttattctgggatgtttctcagcagggctgcctaaaacggaggccaactgggtcaacgttatcagcgatctgaagaagatcgaagatcttatccaatccatgcatattgacgccaccctttacactgagtcagatgtgcatccgtcgtgcaaggttaccgcgatgaagtgttttctgctggaacttcaggtgatatccctggagtcgggcgatgcctcgattcatgacaccgttgagaatttgattatactcgccaataactcgctttcgagcaatggaaatgtgaccgaatccggatgtaaggaatgcgaagagctcgaggaaaagaacattaaggagtttctgcagagctttgtgcacattgtccagatgtttatcaacactagc

SEQ ID NO: 33166 - DNA, 486 bp, Artificial Sequence
  Description of Artificial Sequence: Synthetic coding sequence
atgagaatctccaaaccacacctgaggtccatctccatccagtgctatctgtgcctgcttctgaacagtcattttttgaccgaagccggcattcatgtctttattttgggttgtttcagtgccggcctcccgaaaacagaggctaactgggtgaacgtgatatcagatcttaaaaagattgaggacttgattcagtcaatgcacattgacgccactctgtatacagagagcgatgttcaccccagttgtaaggtaaccgctatgaaatgtttcctgctcgaactgcaagttatctcactagaaagtggggatgccagcatacatgatacagtcgagaatctaattatcctcgcgaataatagcctatccagcaatggcaacgtgacggagagcggatgcaaggaatgcgaggagctggaggaaaagaatattaaggagttcctccaatccttcgtgcatatcgtgcagatgttcatcaatacctcc

SEQ ID NO: 33167 - DNA, 486 bp, Artificial Sequence
  Description of Artificial Sequence: Synthetic coding sequence
atgcggatttccaagccacatctcagatcgatatcaatccaatgttacctctgtctgctgttgaactcacatttcttgacggaggcaggaatccacgtctttattcttggatgtttttccgccggactgccaaagactgaggcaaattgggtgaacgtgattagcgatctgaaaaagattgaagatctcattcaatcgatgcatattgatgcaaccctttacactgaaagcgacgtccacccttcgtgcaaggtaaccgctatgaagtgtttccttctggaacttcaggtgatttcgcttgagtcgggggatgcaagcatccatgacacggtcgagaatctgatcatcctggcgaacaactccctgtctagcaatggtaacgtgactgaaagtggatgcaaagaatgcgaggaactggaggaaaagaacattaaggagttcctgcagagctttgtgcacatagtacaaatgtttatcaacacttcc

SEQ ID NO: 33168 - DNA, 486 bp, Artificial Sequence
  Description of Artificial Sequence: Synthetic coding sequence
atgaggatttctaagccccatctgcggtcaatttcaattcaatgctatctctgcctcctcctcaactctcacttcctcaccgaagcaggcattcatgtattcatactcgggtgtttctccgccgggctgcctaagacagaagctaactgggtcaatgtaatctccgatctcaaaaaaatagaggatctcatccagtccatgcacattgacgccacactgtacacggagtccgatgttcacccgagttgcaaggttacggctatgaagtgttttctcctggagctacaggtaatctccctggagagtggagacgcttctatacatgatacagtcgaaaacctgattatccttgcaaataatagcctgagttcaaacggcaatgtaacagagagcggctgtaaggaatgtgaggaactcgaggagaaaaacattaaagaattcctgcaaagcttcgtacacattgttcagatgttcatcaatacttcc

SEQ ID NO: 33169 - DNA, 486 bp, Artificial Sequence
  Description of Artificial Sequence: Synthetic coding sequence
atgagaatttccaagccccatctgaggagcattagcattcaatgctatctgtgtctgttgctaaatagccatttccttacagaagccggcattcatgtgtttatcctcgggtgtttcagtgccggtctgcctaaaacagaggctaactgggtgaatgtgatcagcgacctgaagaaaatcgaagatctgatccagtcaatgcatatcgatgcgaccctctatacggaatctgatgtgcaccctagctgtaaagtgactgccatgaagtgttttctgttggaactccaagtgatctctttagagtccggagatgccagtatccacgataccgtagaaaatctgatcatactggccaataacagcctatctagcaacggaaacgtcaccgagagcggctgtaaggagtgtgaagagctagaggaaaaaaacattaaggagttcctgcagtctttcgtgcatatagtgcagatgtttattaatacaagt

SEQ ID NO: 33170 - DNA, 486 bp, Artificial Sequence
  Description of Artificial Sequence: Synthetic coding sequence
atgcggattagtaaaccccatctgagaagcattagcatccagtgctacctttgtctcctgcttaactcccacttccttaccgaagctggtattcacgtctttatcctgggatgttttagcgcagggcttcctaaaacggaggcgaattgggtgaatgtgatctcggaccttaagaagatagaagatctcatacaatccatgcacatagatgccaccctctacaccgagtcagacgtgcatccgtcctgcaaagtgactgcaatgaagtgttttttgctcgaacttcaggtcatttccctcgaatcaggcgatgcctccattcatgatacggttgagaatctgatcatacttgctaacaactccctttcgtcgaacggaaacgtgactgaaagtggatgcaaggaatgtgaagaactggaggaaaagaacatcaaggaatttctgcaatcgtttgtccatattgtgcaaatgtttatcaacacgtcg

SEQ ID NO: 33171 - DNA, 486 bp, Artificial Sequence
  Description of Artificial Sequence: Synthetic coding sequence
atgcgtatatcgaagcctcatctgagatctatttccatccaatgctatctgtgtctgctgcttaactcgcactttttgactgaagcaggaatccatgtgtttatactgggttgtttcagcgcaggactgcccaagactgaagcgaattgggttaacgtgatctcggatctcaagaaaatcgaggacctcattcaaagcatgcacatcgacgcaaccctttacaccgaaagtgatgtccatccaagctgtaaggtcactgctatgaagtgctttcttcttgagcttcaggtaatctcactcgagtcaggggatgcaagcatccatgacacggtggaaaatctgattattctggccaacaactccctgtcaagtaatggtaatgtgaccgaatccggatgtaaagaatgcgaagagttggaggaaaagaacataaaagagtttctccagagctttgtccacattgtgcaaatgttcattaacacctcg

SEQ ID NO: 33172 - DNA, 486 bp, Artificial Sequence
  Description of Artificial Sequence: Synthetic coding sequence
atgcggatcagcaagcctcatttacggagcatcagcattcagtgctacctctgcctcctgctgaacagccactttctaaccgaagcaggtatacacgtgtttatcctcggctgttttagtgccgggctccccaagaccgaggctaattgggtgaatgtcatctcagatctcaaaaagattgaggacctcattcagtcaatgcacatagacgcaactctatatacagagagcgacgtgcatccgtcatgcaaagtaaccgccatgaagtgcttcttactggagctgcaggtgataagcctggagtcaggagatgcgagtatacacgacactgtagagaatttgatcatcctggcgaataattcgctgtccagcaatgggaacgttacagaaagcggctgtaaggaatgtgaggaactggaagaaaagaacattaaggaattcctgcagtccttcgtgcacatagtgcagatgtttattaacacatcc

SEQ ID NO: 33173 - DNA, 486 bp, Artificial Sequence
  Description of Artificial Sequence: Synthetic coding sequence
atgaggatctccaaacctcatctgaggtcaatctccatccagtgctacctgtgcctgctgctcaacagccatttcctcacagaggcaggaatccacgtgttcattctgggttgcttttccgcaggacttcctaaaaccgaagctaattgggtgaatgtcataagcgacctgaagaagatcgaagatctgattcagagcatgcacattgacgcaactctgtatacagagtccgacgtccatccaagttgcaaggtaactgccatgaagtgctttctgttggagctccaagtgatctcacttgagagcggtgatgcctcaattcacgacacagtcgaaaatctgataatcctcgctaacaacagtctgtcctcaaacggtaatgtgacagagtcaggctgtaaggagtgcgaggagctcgaggagaagaacattaaagaattcctgcagtccttcgtgcacatcgtccaaatgtttattaacacctca

SEQ ID NO: 33174 - DNA, 486 bp, Artificial Sequence
  Description of Artificial Sequence: Synthetic coding sequence
atgcgcatttcaaagccacacctgaggtccatttcaattcaatgttatctgtgtctcctgctgaacagccatttcctgacagaggcaggtattcacgtgtttatcttaggttgcttcagcgcagggcttcctaaaaccgaggccaactgggtgaacgtcatcagtgacttgaagaaaatcgaagatctgatccaatcaatgcacatcgatgcaacattatatacggaaagcgatgtgcacccatcttgtaaggttaccgctatgaagtgcttcttgcttgagctccaggtgatctctcttgaatccggcgatgcctccatccacgacactgtcgaaaacctgatcattttggccaacaacagtctgagctcaaacgggaatgtgactgaatccggctgcaaggagtgcgaggagctagaagaaaaaaatatcaaagaattcctccaaagcttcgttcacatcgtccagatgttcatcaatacatca

SEQ ID NO: 33175 - DNA, 486 bp, Artificial Sequence
  Description of Artificial Sequence: Synthetic coding sequence
atgcgcatctctaagccacatctcaggtccatctccattcaatgctacctctgcctccttctgaactcacatttcctcaccgaagctggcattcacgtgtttatcttgggctgtttctctgcgggtctccccaagaccgaggctaactgggttaatgtcatttcagacttgaagaagatcgaagacctcatccaaagtatgcacatcgacgcaacgctttacacagagtcagacgtgcacccctcttgcaaagtgacagctatgaagtgcttcctgctggagctgcaagttatttccctggaaagtggcgatgcttcaatccatgacactgtggagaacctcatcatcttggcaaacaatagcctcagctccaatggaaacgtgactgaatctggctgtaaggaatgcgaggagttggaggagaagaatatcaaggaatttcttcagagttttgtccacatcgtgcagatgtttatcaatacttct

SEQ ID NO: 33176 - DNA, 486 bp, Artificial Sequence
  Description of Artificial Sequence: Synthetic coding sequence
atgagaatctcgaagccacacctgcggtccatctccatccagtgttacctctgcctgttgctgaactcccacttcctgactgaagcaggaatccacgtgttcatcctcggatgcttctccgccggcctgcctaagaccgaagctaattgggtgaacgtgatcagcgatctcaagaaaatcgaggacctgatccagtcaatgcatatcgacgcaacgctgtacaccgaatccgacgtgcacccgagctgtaaggtgactgccatgaagtgtttcctgctggagctccaagtgatctcgctcgaatcaggcgacgccagcatccacgacaccgtcgagaacctcatcatcctggcaaacaactcactgtcctcgaacggaaacgtgactgaaagcggctgcaaggaatgcgaggaactggaggagaaaaacattaaagagttccttcaatcattcgtccatatcgtccagatgttcatcaatacgtcc

SEQ ID NO: 33177 - DNA, 486 bp, Artificial Sequence
  Description of Artificial Sequence: Synthetic coding sequence
atgcgcatctctaaaccccacttgcgctctatttccatccaatgttatttgtgcctcctcctgaactctcatttcttgacggaagccggtatccacgtcttcattctgggctgtttcagcgccggtttgcctaagacggaagcgaactgggtaaatgtaatttccgacctcaagaagatagaagatttgatccagagcatgcacatcgacgctacgttgtatacggaaagtgacgtccacccgtcctgcaaggtgacggccatgaaatgtttcctgttggagttgcaggttatctcattagagagcggggatgcgtctatacacgataccgtggaaaatctgatcattttggcgaacaactctctgtcgtccaatggaaacgtcacagagagcggatgtaaggaatgcgaggaattggaagaaaagaatataaaggagttcctccagtcgttcgttcatattgtccaaatgtttatcaatactagc

SEQ ID NO: 33178 - DNA, 486 bp, Artificial Sequence
  Description of Artificial Sequence: Synthetic coding sequence
atgcgaatctccaaacctcacctgcggagtataagtatccaatgctatctctgcttactgctaaacagccacttcctcactgaagctggcatacacgtgttcattctgggctgtttttccgctgggttacccaaaacagaagccaattgggtcaacgttatctccgacctgaagaagatagaggacctgattcagtccatgcatattgatgccacattatacaccgaatcagacgtccaccccagctgcaaggtgaccgccatgaagtgtttcctgcttgaactgcaggtgatctctcttgaaagtggcgacgcctctatccatgacaccgtcgagaatctaatcatcctggccaacaacagtctaagctcaaatggcaatgttacagagtcagggtgcaaagaatgtgaggagttggaggaaaagaacatcaaggaattcctgcagtcatttgtacatatcgttcagatgttcatcaatacctct

SEQ ID NO: 33179 - DNA, 486 bp, Artificial Sequence
  Description of Artificial Sequence: Synthetic coding sequence
atgaggataagtaaaccgcacctgagatccatttcaatccaatgttacttgtgtctgctcctgaattcccactttctgacagaggctgggatccacgtattcattctgggctgttttagcgctgggttgccaaagaccgaggccaattgggtgaacgtgataagtgatctgaagaaaattgaggacctaatccaatcaatgcatatcgacgcaaccctgtacacagagagcgatgtgcacccgtcttgcaaggtgaccgctatgaagtgttttctgctggaattgcaagttattagcctggaatcaggggacgcatcgattcacgacaccgtggagaatctaatcatccttgcaaataactcgctcagcagtaacggtaacgtgacggagtctggctgtaaggaatgtgaagagctcgaggagaaaaatatcaaggagttcctgcagagctttgtccacatcgtccagatgttcatcaatacgagt

SEQ ID NO: 33180 - DNA, 486 bp, Artificial Sequence
  Description of Artificial Sequence: Synthetic coding sequence
atgagaatctccaagcctcacttgcgctcgatctcgatccagtgctacctctgtctgctgctgaactcacatttcctcaccgaagccggcatccatgtctttatcctgggatgcttttctgccgggttgccaaagactgaggccaactgggtcaacgttattagcgatctgaaaaagatcgaggacctcatacagtcaatgcacattgacgcgaccctttacaccgagtctgacgtgcacccgtcttgtaaagtgaccgcgatgaagtgcttccttttggaactgcaagtgatcagcctggaatcaggagatgctagcattcacgacactgtggaaaatctcatcatcctggcaaataactcgctgtcgtcgaatggaaacgtgactgaatccggttgcaaggagtgcgaggagttggaggaaaagaacatcaaagagttcttgcagtccttcgtgcatatcgtccaaatgttcataaacaccagc

SEQ ID NO: 33181 - DNA, 486 bp, Artificial Sequence
  Description of Artificial Sequence: Synthetic coding sequence
atgagaatctccaaaccacacttgcggtctatttccatccagtgttacctgtgccttctgctgaattcgcactttctgaccgaggccggcattcatgtctttatacttggttgtttttcggcaggacttcctaagacggaagctaactgggtgaatgtgatctccgatctcaagaagatcgaagatttgatacaaagcatgcatattgatgcaactctgtacactgaatccgacgtccatccttcgtgtaaggtgaccgcgatgaagtgttttcttctggaactgcaggtgatctcgcttgaatcgggagatgcctctattcacgatactgtcgagaatctgattatcttggcaaacaatagccttagcagcaacggtaacgtgaccgaaagcggttgtaaggagtgcgaggaactcgaagaaaagaacatcaaagaatttcttcaatcgttcgtgcatatagtacagatgttcatcaacacctcg

SEQ ID NO: 33182 - DNA, 486 bp, Artificial Sequence
  Description of Artificial Sequence: Synthetic coding sequence
atgcgcatcagcaagccgcacttgagatcgattagcatccagtgctacctctgcttgctcctcaactcgcacttcttgactgaagccggcattcacgtgtttatcctgggatgtttcagcgccggactgccgaaaacggaagctaactgggtgaacgtcatcagtgacctgaaaaagatagaggatctgatccaatccatgcatattgatgccaccctgtacaccgaatcggacgtccatccatcatgcaaggtgaccgcaatgaagtgctttttgctcgagctgcaagtgatcagcctggaatcaggagatgcgagcatccatgacaccgtggagaatcttatcatcctggccaacaactcattgtcgagcaatggtaacgtgactgaatcaggatgcaaggagtgtgaggagcttgaggagaaaaacatcaaggaattcctgcagagctttgtacatatcgttcaaatgttcatcaatacgtcc

SEQ ID NO: 33183 - DNA, 486 bp, Artificial Sequence
  Description of Artificial Sequence: Synthetic coding sequence
atgcggatctccaaaccacatctgagatccatcagcatccaatgctacttgtgtctcctccttaacagccacttccttaccgaagcaggaatacatgtgtttatcctgggatgcttctccgcaggactgccaaagactgaggccaattgggtgaacgtgatctcagacctgaaaaagatcgaggacttgattcaatccatgcacatcgatgccaccctgtacacggaatccgacgtgcacccgtcctgtaaagtgactgcaatgaaatgcttcttgctggagctgcaggtgatttcactggaaagcggcgatgccagcatccatgataccgtagaaaacctcatcatcctggcgaacaattccttgagttccaatggtaacgtgacggaatcgggctgcaaggagtgcgaggagctggaagaaaagaacatcaaggaatttctccagagcttcgtgcacatcgtgcagatgttcatcaacacttca

SEQ ID NO: 33184 - DNA, 486 bp, Artificial Sequence
  Description of Artificial Sequence: Synthetic coding sequence
atgcggatcagcaagccacatttgaggtcgatctcgatccaatgctatctgtgcctgcttctgaactcgcactttctgactgaagcgggaatccatgtgtttatcctgggatgtttcagcgccggactgccgaaaaccgaggctaattgggtgaacgttatctcagacttgaaaaagatcgaggatctgatccagtccatgcatatcgacgcaaccctctacaccgaatccgacgtccacccatcatgcaaagtgaccgctatgaagtgtttcctcttggagttgcaggtcatttcactggagtcaggcgacgcctccattcatgataccgtggagaatctcatcattctcgctaacaattcactgtcgagcaacggaaacgtgaccgagagcggatgcaaggagtgcgaagagctcgaagagaaaaacatcaaggaatttctgcagagcttcgtgcacatcgtccagatgttcatcaacaccagc

SEQ ID NO: 33185 - DNA, 486 bp, Artificial Sequence
  Description of Artificial Sequence: Synthetic coding sequence
atgagaatttctaagccacatctcagatcgatctcgatccaatgttacctttgtctccttctcaactcacatttccttaccgaagcagggattcatgtgtttattctgggttgttttagcgcaggcctgccaaagactgaagccaactgggtcaacgtgatctccgatctgaaaaagatagaagatctgatccagagcatgcatattgatgcaactctttacaccgagtccgatgtgcatccctcctgtaaggtgactgcgatgaagtgctttcttctggagctccaagtcatttccctcgaatccggggatgcatcgatacacgacactgtggagaacctgatcattctggcaaacaattcgttgagctcaaacggcaacgtgactgaaagcggatgtaaggagtgcgaagaacttgaagaaaagaatatcaaagaattcctgcaatcctttgtccatatcgtgcagatgttcattaacacttcc

SEQ ID NO: 33186 - DNA, 486 bp, Artificial Sequence
  Description of Artificial Sequence: Synthetic coding sequence
atgcgcatttccaagccccacttgagatccatcagcattcaatgttacctctgcttgctgctgaactcgcattttctcaccgaggcaggcatccacgtattcatcctgggttgcttcagcgcagggctgcctaagactgaggcgaattgggtgaatgtcatctcagatctcaagaagatagaggaccttattcagagcatgcacatagatgccactctctacacggaatcggacgtccatccgtcatgcaaagttaccgctatgaaatgcttcctcctcgaacttcaagtcatctcactggagtcgggggacgcctcaatccacgacaccgtggaaaacctgataatccttgcgaacaattcgctgagttccaacggaaacgtgactgaatccggatgcaaggaatgtgaggagctggaagaaaagaacatcaaggaatttctccagtcgttcgtgcatatcgtgcagatgttcatcaatacctca

SEQ ID NO: 33187 - DNA, 486 bp, Artificial Sequence
  Description of Artificial Sequence: Synthetic coding sequence
atgcgcatctccaaaccgcacctccgttccatctctattcaatgctatctctgcctgttgttaaattcacatttcctcactgaagcaggcattcatgtgttcattttaggctgtttttctgccggactgcctaagactgaggcgaattgggttaatgttattagtgacctcaagaaaatcgaagatttgattcagagtatgcacattgatgccaccctctacactgagagcgacgttcacccttcttgcaaggtcacggctatgaagtgcttcctccttgaattgcaggtcatctccctggaaagtggcgacgcgtcgattcatgataccgttgaaaacctgattatcctggctaacaattccttgtcgtctaatgggaacgttacagagtcagggtgtaaagagtgcgaggagcttgaggagaagaacataaaagagtttctccaatctttcgtgcacattgttcagatgttcatcaacaccagt

SEQ ID NO: 33188 - DNA, 486 bp, Artificial Sequence
  Description of Artificial Sequence: Synthetic coding sequence
atgagaatttctaagccccacttaagatcaatctctattcagtgttacctgtgcctgctgctgaatagccactttctgacagaggccggaattcatgtgtttatcctagggtgcttcagtgctggtctgccaaagaccgaggcaaactgggtaaatgtcatctccgatctgaagaaaatcgaagatctgatccaatccatgcatatcgacgctactctatacacagaatctgatgttcatccgtcctgtaaggtgaccgccatgaagtgcttccttctagagctgcaggtgatatccttggaatctggcgatgcatctatacacgataccgtcgaaaacctgatcattttggctaataactctttgtcttcaaatggaaatgttactgaatccggctgcaaggaatgtgaggaactcgaggagaagaacatcaaggagtttctgcagtcctttgtgcatatagtgcagatgttcatcaacacctcc

SEQ ID NO: 33189 - DNA, 486 bp, Artificial Sequence
  Description of Artificial Sequence: Synthetic coding sequence
atgcgaatttcaaaaccacatcttcggagcatttccatccaatgttacctttgtctgcttcttaacagccacttccttaccgaagcaggcattcatgtgtttatccttggatgtttttcagccggactccccaagactgaagcaaactgggtgaacgtgattagcgacctcaaaaagatagaagatctcatccagagcatgcacattgatgcaactctttacactgaatcagacgtccatccttcttgcaaggttaccgctatgaagtgctttctgctcgaacttcaagtcatatccctggaatcgggagacgcgtcgattcacgataccgtggagaatctcattatactggctaacaattcgctctcatccaacggtaacgtgactgaaagcggctgcaaagagtgtgaagagcttgaggagaagaacattaaggagttcttgcaatcgttcgtccatatcgtgcagatgtttatcaatacctcg

SEQ ID NO: 33190 - DNA, 486 bp, Artificial Sequence
  Description of Artificial Sequence: Synthetic coding sequence
atgcggatctcaaagccgcacttgaggagcatatcaatccaatgctatctctgtctgctcctgaacagccatttcctgacagaggccgggatccacgtcttcatattgggctgtttcagtgctgggcttccaaagacggaggccaactgggtgaatgtcatctctgacctgaagaaaatcgaggacctgattcagtctatgcacattgacgccaccctgtacaccgaatctgacgtccacccatcatgtaaggtcacagctatgaagtgcttcttattagaattgcaggttatctctttggagtctggcgacgcatcaattcacgatacagttgaaaatttaattattctcgctaacaactccctgagttcaaacgggaacgtgactgaatcaggctgtaaggagtgtgaagaactggaagagaagaacattaaggaatttctgcaaagtttcgtccacatcgtgcagatgttcattaacaccagc

SEQ ID NO: 33191 - DNA, 486 bp, Artificial Sequence
  Description of Artificial Sequence: Synthetic coding sequence
atgcggatctccaaaccacacctgcggtccatctcgatccagtgctacctgtgtctgcttctcaacagccacttccttaccgaagccggaatccacgtgtttatcctcggatgcttctcggctgggctgcctaagaccgaggcgaactgggtcaatgtgataagcgacctgaaaaagatcgaagatctgatccaatcgatgcacatcgacgcaaccctgtacacggagtcagatgtccacccgtcatgtaaggtgactgccatgaagtgcttcctgctcgaacttcaagtgatctccctcgagagtggcgacgcaagcatccacgatactgtggagaatcttatcattctggcaaacaactccttgagctctaatggcaacgtaaccgaatcgggatgcaaagagtgcgaagaactcgaggaaaagaacatcaaggaatttctccagtcctttgtccacatcgtccagatgttcattaacacgtcc

SEQ ID NO: 33192 - DNA, 486 bp, Artificial Sequence
  Description of Artificial Sequence: Synthetic coding sequence
atgcgtatctccaagccacacctcaggtctatatcaattcaatgttacctgtgcctgctgcttaacagtcacttcttaaccgaggcaggaatccatgtttttattctggggtgttttagcgcgggcttacccaaaacggaggccaactgggtaaatgttatttccgatcttaagaaaatcgaggatcttatccagtccatgcacattgacgctacattatatacagagtcagacgttcacccgtcctgtaaggtgacggctatgaagtgcttcctgctggagctgcaggtgatcagtctggaatcaggagacgcctccatacatgacactgttgaaaatctgattatattagccaataatagtctcagcagtaatgggaacgtaacagaatcgggctgtaaagagtgcgaggagttggaggagaaaaacattaaagagttcttacaaagcttcgtgcacatagttcagatgtttataaacacttct

SEQ ID NO: 33193 - DNA, 486 bp, Artificial Sequence
  Description of Artificial Sequence: Synthetic coding sequence
atgagaataagtaaaccacatcttagatcaatttcaatacaatgttatttatgtttacttttaaattcacatttccttacagaagctggaatacatgtatttattttaggatgtttttctgctggtttaccaaaaacagaagctaattgggtaaatgtcatttctgatttaaaaaaaattgaagatttaatacaatctatgcatattgatgctacattgtatacagaatctgatgtacatccaagttgtaaagttacagcaatgaaatgttttttgttagaattacaagtaatttctttagaatcaggagatgcatcaatacatgatactgtcgaaaatttaattattcttgcaaataattcactttcaagtaatggaaatgttacagaatcaggttgtaaagaatgtgaagaattggaggaaaaaaatataaaggaatttttacaatcatttgttcatattgttcaaatgtttattaatacttca

SEQ ID NO: 33194 - DNA, 486 bp, Artificial Sequence
  Description of Artificial Sequence: Synthetic coding sequence
atgagaatctcaaaacctcatctgcggtccatctcaatccagtgctacctgtgtctgttgctgaattctcactttttgaccgaggccggaatccacgtctttatcctgggttgcttctcggcggggttgccaaagacggaagcaaactgggtcaacgtgattagcgatctcaagaagatcgaggacctcatccagtcgatgcacattgatgctactctgtacaccgaaagcgacgtccacccgtcgtgtaaggtgactgccatgaaatgcttcttgttggaactgcaggtcatatcccttgaaagcggcgatgcttcaatccatgacactgtggagaacctcatcatcttggcaaacaactcgctgtcgtccaatggtaatgtgaccgaatcggggtgcaaggagtgcgaggaactcgaagaaaagaacattaaggaatttctgcagagcttcgtgcatattgtgcaaatgttcatcaataccagc

SEQ ID NO: 33195 - DNA, 486 bp, Artificial Sequence
  Description of Artificial Sequence: Synthetic coding sequence
atgagaattagcaagccacatttgagaagtatctctattcagtgctatctctgtctacttttgaatagtcattttctaacagaggcggggattcatgtgtttattcttggatgttttagcgccgggttaccaaagacggaggccaactgggtgaacgtcatatctgatttgaagaaaattgaggatctaattcaatcaatgcatattgatgctacattgtatacagagtctgatgtacacccatcgtgcaaagtcacagctatgaagtgctttttgcttgagcttcaagtgatctcactagagtctggggacgcctctattcatgacactgttgagaaccttataattttggcaaataatagtctgtcatctaacgggaatgtgaccgaatcaggatgcaaagaatgtgaggaacttgaagaaaagaatatcaaggagttccttcagagttttgtccatattgtgcagatgttcattaatacaagc

SEQ ID NO: 33196 - DNA, 486 bp, Artificial Sequence
  Description of Artificial Sequence: Synthetic coding sequence
atgcggatcagcaagccgcatctacgttccatttctattcaatgctacctgtgtctgcttctcaatagccactttctgaccgaggctggtattcatgttttcatcctgggctgttttagcgcgggtctgccaaagacggaggcgaattgggttaatgtcatcagcgacttgaaaaaaatagaggatctgattcagagtatgcacattgatgccaccctgtacaccgaaagcgatgtacacccatcctgcaaggtgacggcgatgaagtgctttcttctggagttgcaggtgatctcgctcgaaagcggtgacgcatctatccatgacactgtagagaacctgatcatcctggcaaacaacagcctgagcagcaacggaaacgtcaccgagagcggatgcaaggagtgtgaagaactcgaagaaaaaaacattaaggaattcctgcaatctttcgttcacattgtacagatgttcatcaacacctcc

SEQ ID NO: 33197 - DNA, 486 bp, Artificial Sequence
  Description of Artificial Sequence: Synthetic coding sequence
atgcgaattagcaaaccccacctgcgatcgatctcgattcagtgctacctttgcctcctgctgaatagccatttcctcaccgaggcaggaatccatgtgtttatacttggctgcttctccgctgggctccctaagactgaagctaactgggtgaacgtcataagcgatctcaagaaaatcgaggaccttatccagtcgatgcacatagatgcaactctgtacactgaatcagacgtgcatccttcgtgtaaggtcactgcgatgaagtgctttcttctggagctgcaagtgatttcgcttgaatcaggagatgccagcatccatgatacggtggagaatctgattattctggcaaataactccttgagctccaatggtaacgtcaccgagtcaggatgtaaggaatgcgaagaattggaagagaaaaacatcaaggaatttcttcagagctttgtgcatatcgtgcagatgttcattaacacctcc

SEQ ID NO: 33198 - DNA, 486 bp, Artificial Sequence
  Description of Artificial Sequence: Synthetic coding sequence
atgcgcatttccaagccacatctccgctcgatctcgatccaatgttacctgtgcctgttgctcaattcgcactttctgaccgaagcgggaatccatgtctttatcctcggttgcttctcagcaggactccctaagactgaggcaaactgggtgaacgtgatcagcgacctgaagaagatcgaggatctcatccagtcgatgcacatcgacgcaactctctacaccgagtccgatgtgcacccgtcctgcaaggtgaccgccatgaaatgctttctgctcgaactgcaggtgatcagcttggagtcgggagacgcctcaatccatgatactgtggagaacctgatcattctggctaacaattcgctgtcgtcaaatggcaacgtgaccgagtcgggttgtaaggagtgtgaggaactggaggaaaagaatatcaaggaattcctccagtcattcgtgcacatcgtgcagatgttcatcaacacctca

SEQ ID NO: 33199 - DNA, 486 bp, Artificial Sequence
  Description of Artificial Sequence: Synthetic coding sequence
atgcggatctcgaagcctcatctcaggtcaataagcattcagtgctacctttgtttgctgctcaactcccacttccttaccgaagcgggcattcacgtgtttatactgggttgcttttcagcagggcttccaaaaactgaagcaaattgggtgaatgtcatttcggaccttaagaaaattgaagatcttattcaaagcatgcatattgatgctaccctgtacactgagtcggacgttcatccttcatgtaaggtgacggccatgaagtgcttcctgctggaactccaagtcatcagcctggagtcgggcgacgcatcgatccatgatactgtggaaaacctcataattctggctaacaacagcttgtcctccaatggaaacgtgacggagtcaggttgcaaggaatgtgaggagctcgaagagaagaacataaaagagtttcttcagagctttgtgcacattgtccaaatgttcatcaatacctcc

SEQ ID NO: 33200 - DNA, 486 bp, Artificial Sequence
  Description of Artificial Sequence: Synthetic coding sequence
atgcgcatttccaaaccgcacctccgatccatctctatccagtgctacctgtgtctcctcttgaactcacattttctgactgaagcggggatccacgtgttcattctgggatgcttctctgccggcctcccaaagactgaagccaactgggtcaacgtgatctcagatctcaagaaaatcgaggacctcatacaatccatgcacatcgatgccactctgtacacggagtcagatgtgcatcccagttgtaaggtgaccgctatgaagtgcttcttgctcgaactgcaggtgatttcgcttgagtcgggagacgcgtcgatccacgacaccgtcgagaatctgatcatcctcgcaaacaattcgctgtcatctaacggcaacgttacggaatcgggatgtaaggaatgcgaggagctggaagaaaagaacatcaaagaattcctgcagtcgtttgtgcatattgtccaaatgttcatcaatacctcc

SEQ ID NO: 33201 - DNA, 486 bp, Artificial Sequence
  Description of Artificial Sequence: Synthetic coding sequence
atgcgcatttccaagcctcatcttaggtcaatctcaatccagtgctacctttgccttttgcttaattcacatttcctgaccgaagcgggaattcatgtgtttattctgggatgctttagcgcaggccttccaaaaactgaagcaaattgggtgaatgtcatctccgatctgaagaagattgaagatcttatacaatctatgcacatagatgcaaccctttacaccgaatccgatgtccacccttcatgtaaagtcaccgcaatgaagtgttttcttcttgagctgcaagtgatttcgctggaatccggcgacgcgagcatccatgatactgtcgagaatctcatcatcttggcaaacaactccctttcgtcaaatggcaatgtgaccgaaagcggttgtaaagaatgtgaagaactggaggaaaagaacatcaaggagtttctgcaatcgtttgtgcacattgtgcagatgttcattaacacctct

SEQ ID NO: 33202 - DNA, 486 bp, Artificial Sequence
  Description of Artificial Sequence: Synthetic coding sequence
atgcgaatctctaaaccacacctgcggagcatttcgatccagtgttacctgtgtttgctgcttaactcccactttctgactgaggccggtatccatgtcttcatcctgggctgcttcagtgctggcctgcccaaaacggaagccaactgggttaacgtcatcagcgatctgaagaaaatcgaggatctgattcagagtatgcatattgatgccactctctacacagaaagcgacgttcatccctcctgtaaggtgacagccatgaagtgttttttgctggagctccaggtgatctccctagaaagcggggacgccagcattcacgacactgtggagaacctcattattctagccaataattctctttcaagcaatggcaacgtgactgagtcgggatgcaaggagtgcgaagagttagaggaaaagaatattaaggaattccttcagtcattcgtccacattgtgcagatgttcataaatacaagt

SEQ ID NO: 33203 - DNA, 486 bp, Artificial Sequence
  Description of Artificial Sequence: Synthetic coding sequence
atgcgtatctctaagccacatcttcgaagtatcagtattcagtgctacctgtgcctcctcctaaattcacactttcttaccgaggctggaattcacgtgttcatactggggtgcttttccgctggactacctaagaccgaggcgaactgggtcaacgtgatcagcgatctaaagaaaatcgaggatctgatccagagtatgcatatcgatgctacactgtacaccgagtctgacgtgcacccatcatgtaaggtcacagccatgaagtgttttcttctggagctgcaggtcattagtctggagagcggtgacgcctcaattcacgatacagtagagaacctcatcatactggctaataattctctcagcagcaacggtaacgtaacagagtcaggatgcaaggagtgcgaggagcttgaagaaaagaatatcaaagagttccttcagagctttgttcacatcgtgcagatgttcatcaatacaagc

SEQ ID NO: 33204 - DNA, 486 bp, Artificial Sequence
  Description of Artificial Sequence: Synthetic coding sequence
atgcgtatctctaaaccgcacctgaggagtataagcatccagtgttatctgtgtttgctcctgaacagtcatttcctcaccgaagcaggcatccacgtattcatactgggctgtttctcagctgggctgcctaagactgaggccaattgggtgaacgtgattagtgacctcaagaagatcgaggacctgatacaatctatgcatatcgacgcaaccctttacaccgaatctgatgtgcacccttcatgcaaggtcaccgccatgaaatgctttcttttagagctgcaggtgattagcttagagagcggagacgccagcattcacgacaccgtagagaatctgatcatcctggctaacaactctctctcatcaaatggtaacgttaccgaaagcggatgcaaggagtgcgaggagctcgaggaaaaaaacataaaggagtttcttcagagtttcgtgcatatcgtccaaatgtttatcaacacctca

SEQ ID NO: 33205 - DNA, 486 bp, Artificial Sequence
  Description of Artificial Sequence: Synthetic coding sequence
atgaggatcagtaaaccacaccttaggtcaatatctatccaatgctacctttgcctgctgttgaacagccacttcctgactgaggcggggatccacgtgtttattctgggatgtttctcagccggacttccaaagaccgaagcaaattgggtgaacgttatttcagacctgaaaaagatcgaggacctgatccagagtatgcacatcgatgcaactctgtatactgaaagcgatgtgcatccttcctgtaaggtcaccgcaatgaagtgttttcttctggaactgcaggtgataagcctcgagagcggagacgcttccatccacgacacggtggagaacttgattattctcgccaataacagtctgagcagtaacggaaacgtcacagagtccggctgtaaagagtgtgaagagctcgaggagaaaaatatcaaagaatttctccaatcttttgtgcatatcgtgcagatgtttattaatacttct

SEQ ID NO: 33206 - DNA, 486 bp, Artificial Sequence
  Description of Artificial Sequence: Synthetic coding sequence
atgagaattagcaaaccccacctccgctcaatctcgatccagtgctacctctgcctgctgctcaattcccacttcctcacggaggccggcatccacgtgtttatcctggggtgcttcagcgctggactgccgaagactgaggctaattgggtgaacgtcatctccgatctcaagaagatcgaggatctgatccaatcgatgcacattgacgcgaccctgtacaccgaatcagatgtgcatccgagctgtaaagtgactgcgatgaaatgcttcctgttggaactgcaggtgatctcgctggaatctggagatgcttccatccatgatactgtggaaaacctgatcatcctcgccaataactcgctcagctccaacggaaacgtcaccgagagcggatgtaaggagtgtgaagagctggaggagaagaacatcaaagagtttctccagtctttcgtgcatatcgtgcagatgttcattaatacttcc

SEQ ID NO: 33207 - DNA, 486 bp, Artificial Sequence
  Description of Artificial Sequence: Synthetic coding sequence
atgaggatctcaaaaccgcacctccgctctatctcaattcagtgctacctgtgcctgctgctcaatagccatttcctgacggaagccggaatccacgtctttattctgggctgtttctccgcgggcttgcccaagaccgaagccaattgggtcaacgtgattagcgatttgaaaaagatcgaagatctgatccagtcgatgcacattgacgctacgctctacaccgagtccgatgtccacccatcgtgcaaagtcaccgccatgaagtgcttcttgcttgagcttcaagtcatttctcttgagagcggggacgcatcaatccacgacactgtcgaaaatctcattatcctggccaataacagcctgtcctccaacgggaatgttaccgaatccggatgtaaggaatgcgaagagctcgaggaaaagaacatcaaagaattccttcagtcctttgtgcacatcgtgcagatgtttatcaatacttcc

SEQ ID NO: 33208 - DNA, 486 bp, Artificial Sequence
  Description of Artificial Sequence: Synthetic coding sequence
atgagaatctcaaaaccgcacctgcggtcgatctctattcagtgctacctctgccttctgttgaatagccactttctgaccgaagcaggaatccacgtattcatcctggggtgcttctcggccggactcccgaaaaccgaagcgaattgggtgaacgtcatctcggatctgaaaaagatcgaagatctgatccaatcaatgcacatcgacgcaactctttatactgagtccgacgtgcacccttcctgcaaggtgactgccatgaagtgcttcttgctggaactgcaggtgatatcgctggagtcgggtgatgcctcaattcacgacacggttgaaaacctcattatcctcgccaacaattcgctgtcgtcaaacggtaatgtcaccgaatctggatgtaaggaatgcgaagagctggaggaaaagaacatcaaggagtttctgcagtcgtttgtgcatatcgtccaaatgttcatcaacactagc

SEQ ID NO: 33209 - DNA, 486 bp, Artificial Sequence
  Description of Artificial Sequence: Synthetic coding sequence
atgaggatttccaagccacatctgcgcagtatctcaatccagtgttacttatgtctgctcctgaacagccactttctaactgaggcgggcatccacgttttcatcttgggctgcttctccgcaggcttgccaaaaaccgaagcaaactgggtgaacgtgatctccgacttgaaaaagattgaggatttgatacagtctatgcatatcgacgctaccttgtacactgaaagcgatgttcacccgtcctgcaaagttacagccatgaagtgctttttgctcgaactgcaagttatctcacttgagtctggagacgccagtattcacgatacagtcgagaacctgatcatattggctaataactcgctgagctctaacggcaatgtcactgaaagcggctgtaaggagtgtgaggaactggaagagaaaaacataaaagaatttctgcagtcctttgtgcatatcgtgcaaatgtttataaacacaagc

SEQ ID NO: 33210 - DNA, 486 bp, Artificial Sequence
  Description of Artificial Sequence: Synthetic coding sequence
atgcgaatttcaaagcctcacctgcgatccatatcaattcagtgttacctgtgcctgctgctgaatagtcatttcctaacggaagccggaatccacgtgttcattctgggctgttttagtgcaggtctgccaaagaccgaggcaaactgggttaatgtgatcagcgacctcaagaagatagaagacctgattcagtctatgcacatcgatgccacgctgtacaccgagtcagatgtgcacccatcttgcaaagtgacggcaatgaagtgctttcttctggagctccaggttatttcactggagtcgggggatgcaagcatccatgatacagtagagaacttgattatcctagctaacaactccctgagtagtaacgggaacgtgactgagtccggatgtaaggaatgtgaggagcttgaggagaagaatattaaagagtttctccagagttttgtgcacatcgttcagatgtttattaatacgagt

SEQ ID NO: 33211 - DNA, 486 bp, Artificial Sequence
  Description of Artificial Sequence: Synthetic coding sequence
atgagaatctccaagcctcacctgaggagcatatccattcagtgctacctctgcttgctcctgaacagccacttcctcactgaggccgggatccacgtgtttatcctcgggtgtttctcggccgggctaccgaagacagaagcgaactgggtgaatgtgatctccgatctaaaaaaaattgaggatctcatccaatctatgcatattgatgccacattgtacactgagtctgacgtccatccgagctgcaaagtcaccgcaatgaagtgttttttattggagctgcaggtaatcagcttagagtccggggatgccagtatccatgataccgtggaaaatctcattatactggccaacaactctttatcttctaatggcaacgtcacggagtccggttgtaaggaatgcgaagaactcgaggaaaagaatattaaggaattcctacagtctttcgtgcacatcgtgcagatgttcatcaatacctcc

SEQ ID NO: 33212 - DNA, 486 bp, Artificial Sequence
  Description of Artificial Sequence: Synthetic coding sequence
atgcgaatcagcaaaccccatcttcggtcgatttcaatccaatgttacctgtgtttgcttctcaattcacattttctgaccgaagcaggaattcacgtgttcatacttggatgtttttccgccgggcttcccaaaactgaagcgaactgggtgaatgtaatctcggatctgaagaagattgaagatcttatccaatcgatgcacattgacgctaccctctacactgaatcagacgtccatccgagctgcaaggtgaccgctatgaaatgttttctgctcgagctgcaggttatatcgcttgagagcggcgacgcatcgattcatgacactgtggagaaccttatcatacttgccaacaatagcctttcgtccaacggtaacgtgaccgagtccggttgcaaggaatgcgaggaattggaagaaaagaacataaaggaatttctccagtcatttgtgcatatcgtccagatgttcattaacacgtcc

SEQ ID NO: 33213 - DNA, 486 bp, Artificial Sequence
  Description of Artificial Sequence: Synthetic coding sequence
atgcggatttcgaaaccccatctccggtcgatctcgatccagtgttacttgtgccttcttctcaactcccactttttgactgaagccgggatccatgtgttcatacttggatgttttagcgcaggtctgccaaagaccgaggcgaattgggtgaatgtcatttcggacctcaagaagatagaagatctgatacaatcaatgcacattgatgccactctttacaccgaatccgacgtgcatccttcgtgcaaggtcactgccatgaagtgttttttgcttgagttgcaagtcatctcactggaatccggtgatgccagcattcacgataccgtggaaaatcttatcattcttgcaaataacagcctgtcctcaaacggaaatgtaactgagtctggctgtaaggagtgcgaagaacttgaggagaagaacattaaagaatttctccaatcattcgtgcatattgtccagatgttcatcaacacttcc

SEQ ID NO: 33214 - DNA, 486 bp, Artificial Sequence
  Description of Artificial Sequence: Synthetic coding sequence
atgcgtatatcgaagccacaccttagatctatctccatccagtgttacttgtgcctgctgctcaactctcatttcttaacggaggcagggattcacgtgttcattctgggctgcttttcagctggactaccaaagacggaagcaaactgggttaacgtgatcagcgacctaaaaaaaatcgaagatctgatccagtctatgcatatcgacgctacactgtacaccgaaagcgatgtacatccatcctgcaaagtcactgcgatgaagtgtttccttctggaactgcaagtcatcagtttggagtcaggcgatgccagcatccacgatacagtggagaacttaatcatcctggccaataactcactatcttcgaatggaaatgttaccgagtctggatgcaaggaatgcgaggagttggaagaaaaaaacatcaaagagttcctccagtcgtttgtccacattgtccagatgttcatcaacacaagt

SEQ ID NO: 33215 - DNA, 486 bp, Artificial Sequence
  Description of Artificial Sequence: Synthetic coding sequence
atgcggattagtaagccgcatctgcgtagcattagcattcagtgttatttgtgtttattacttaattcgcattttttgacagaggccggtatccacgtgtttatcctgggctgcttcagcgctggactgcctaagaccgaagcgaactgggtgaacgttatctccgatttgaaaaaaattgaagacctgatccagtccatgcatatagatgcaactttgtatacagagagtgatgttcatccctcatgcaaggtgaccgccatgaaatgctttctgttagaattgcaggtcatttctttagagtctggtgatgcaagtattcatgatacagttgaaaatctgattatcttagcaaataacagtctgtctagcaacggcaacgtcacagaatctggttgtaaagagtgtgaggaattagaggaaaagaatataaaagaattccttcagagctttgtccatattgtgcaaatgtttataaacacatct

SEQ ID NO: 33216 - DNA, 486 bp, Artificial Sequence
  Description of Artificial Sequence: Synthetic coding sequence
atgaggattagtaaaccgcacctcaggtctatttcgatccaatgctacctgtgcttgcttctgaattctcactttctgaccgaagccgggatccacgtatttattttaggctgtttctcagctggtcttccgaagacagaagctaactgggtcaatgtcatttccgacttgaaaaagattgaggacctgattcagtcaatgcacatagacgcgacgctctatactgaaagtgacgtgcacccctcatgcaaagtgacggccatgaagtgctttctgctggagttgcaggtgatctctctggaatccggagacgcttccatccacgacactgtggaaaaccttatcatcctggcgaacaattctctgagtagcaacggaaatgtgactgaatccggttgtaaagagtgtgaggagctagaagagaagaacattaaggaatttctgcagtctttcgtgcacatcgtacagatgtttatcaacactagc

SEQ ID NO: 33217 - DNA, 486 bp, Artificial Sequence
  Description of Artificial Sequence: Synthetic coding sequence
atgagaatcagcaaaccgcatctgcgcagcatctcgatccagtgctacttgtgccttctgcttaactcccatttcctcacggaagccggaattcacgtattcatcctcggttgtttctccgcagggctgccgaaaactgaggccaattgggtgaacgtgatctccgatctgaagaagatcgaagatttgatccagtcgatgcacatcgatgctactctctacactgagtcggatgtgcacccgtcttgcaaggtgaccgcgatgaagtgcttcctgctggaactgcaggtcatcagcttggagtcgggcgacgcttcaattcacgacaccgtggaaaacctgatcattttggccaataactcactctccagcaacggtaacgtgactgaatctggatgcaaggagtgcgaagaactggaagaaaagaacatcaaagagttcctgcagagttttgtgcacatcgtccagatgttcatcaatacctcg

SEQ ID NO: 33218 - DNA, 486 bp, Artificial Sequence
  Description of Artificial Sequence: Synthetic coding sequence
atgcgaatcagtaaacctcacttgcgtagtatctcgatacagtgctacttgtgcctgctgctgaattcccatttcctgaccgaggcaggaatccatgtgttcatcctagggtgcttttccgcaggtttgcctaagaccgaggccaactgggtgaacgtaattagcgacctgaagaaaattgaggacctcatccagtccatgcacatagacgcaaccttgtacacagaatctgacgtgcatccttcctgtaaagtgacagcaatgaagtgtttccttttggagttgcaagtcataagtcttgagagcggcgacgctagtatccacgacaccgtcgagaatcttatcatcctcgccaacaactcattatcaagcaacggcaatgtgaccgaaagtggatgcaaggagtgcgaggagcttgaagagaaaaatatcaaagagttcttacaatcattcgttcacatcgtccagatgtttattaacacaagc

SEQ ID NO: 33219 - DNA, 486 bp, Artificial Sequence
  Description of Artificial Sequence: Synthetic coding sequence
atgaggatatcaaaaccgcaccttcgctccatatctatccagtgttacctatgccttcttctaaatagtcacttcctcactgaagctggaatacatgtatttatacttgggtgtttcagtgcagggctacctaaaacagaggcaaattgggtgaacgtgatatctgatttaaagaaaatcgaagatctcatccagtctatgcacattgacgccacactctatacagaatcggatgtgcatccctcctgcaaagttacggctatgaaatgcttcttactcgagctacaggtaatctctctagagtcgggggatgcaagtatccatgatacagttgagaacctaataatcctcgctaacaattcactctcttctaatggaaacgtgactgaatcggggtgtaaagaatgtgaagaactagaagaaaaaaacatcaaagagttcttacaatccttcgttcatatcgtgcagatgttcattaatacttct

SEQ ID NO: 33220 - DNA, 486 bp, Artificial Sequence
  Description of Artificial Sequence: Synthetic coding sequence
atgaggatttctaagccgcacctgcgtagcatatccatccagtgctatttgtgtttgctactgaactcccacttcctgactgaggccggcatccatgtctttattctcggctgtttcagcgccggcctgccaaagaccgaggctaattgggtgaacgttatctccgacctgaagaagatagaggacttgatacaatctatgcacatcgacgccaccttgtacacggagtccgatgtgcatccgagttgcaaagtcaccgctatgaagtgcttcctccttgagctgcaggtgatatcgcttgagtccggcgacgcgagtattcatgatacagtcgagaatctaatcatcctggccaataattccttgagctcaaatggaaacgtgacggagagtggctgcaaggaatgtgaggaattggaggaaaagaatataaaagagttcttgcagagtttcgtgcacattgtccagatgttcataaacaccagc

SEQ ID NO: 33221 - DNA, 486 bp, Artificial Sequence
  Description of Artificial Sequence: Synthetic coding sequence
atgcgtatatcgaaaccgcatctacgatcgatatcgatacaatgttatttatgtctactactaaattcgcattttttaacggaagcgggtatacatgtatttatactaggttgtttttcggcgggtctaccgaaaacggaagcgaattgggtaaatgtaatatcggatttaaaaaaaatagaagatttaatacaatcgatgcatatagatgcgacgctatatacggaatcggatgttcatccgtcgtgtaaagtaacggcgatgaaatgttttttattagaattacaagttatatcgctagaatcgggtgatgcgtcgatacatgatacggtagaaaatttaataatattagcgaataattcgttatcgtcgaatggtaatgtaacggaatcgggttgtaaagaatgtgaagaactagaagaaaaaaatataaaagaatttttacaatcgtttgtacatatagtacaaatgtttataaatacgtcg

SEQ ID NO: 33222 - DNA, 486 bp, Artificial Sequence
  Description of Artificial Sequence: Synthetic coding sequence
atgcgcattagcaagccacatctgcggtccatttctatccagtgctatttgtgcctgctgctcaacagtcattttctcactgaagccgggatccacgtgttcatcctgggatgcttctctgccggattgccgaagaccgaagctaactgggtcaacgtgatttcagatttgaaaaagatcgaggatctgatacagagcatgcacattgatgcaaccttgtacaccgagagcgacgttcacccaagctgcaaagtgaccgctatgaagtgcttccttcttgaactgcaagtaattagtctggaaagcggcgacgcaagtatccacgataccgtggaaaacctcatcatactcgccaacaacagccttagctcaaatggaaacgttaccgagtccggttgtaaggagtgtgaggagctggaggaaaaaaacatcaaggagtttcttcaaagcttcgtgcatattgtacagatgttcatcaacaccagt

SEQ ID NO: 33223 - DNA, 486 bp, Artificial Sequence
  Description of Artificial Sequence: Synthetic coding sequence
atgaggatctctaaaccccatttacgatccatttccatccagtgctacctgtgtctcttgctgaactcccatttcctgacagaggccggtatacatgtgttcatcttgggctgctttagcgctggtctgccaaaaacagaggctaactgggtgaatgtgattagtgacttgaaaaaaatagaagatctgatacagtccatgcatatcgacgcaaccctctataccgaatccgatgtacatccctcatgtaaagtgaccgcaatgaagtgttttctgcttgagctgcaagtcatttcactggagtcaggagacgctagtatacatgacaccgtcgagaacctgattatcctggccaacaattctttgagctctaatggcaacgtgaccgagtccggatgcaaagagtgcgaagagttggaagagaaaaacataaaggagttccttcagtcattcgtacatatcgtgcagatgtttatcaatacctct

SEQ ID NO: 33224 - DNA, 579 bp, Artificial Sequence
  Description of Artificial Sequence: Synthetic coding sequence
atggcggctgagcctgtggaagataactgcatcaatttcgtggccatgaaattcatcgacaataccctctatttcatcgccgaggacgacgagaacttggagtccgattactttggaaaactggagagtaaacttagtgtcattcggaatctgaacgatcaggtcctgttcattgatcaggggaaccgcccgttatttgaggacatgacagattccgactgccgggataatgccccaaggacgatttttataatctcaatgtacaaggatagccaacccagagggatggccgtcacaatttccgtgaagtgtgagaagatatccactctcagctgtgagaataaaattatctccttcaaggaaatgaatccaccagacaatatcaaagacacaaagtctgatattatattctttcagagatcagtgcccggccatgataacaagatgcagtttgaaagtagctcctacgagggatatttcctagcatgtgaaaaagagcgggatttgttcaagttgatcttgaagaaggaggatgagctaggagaccgaagcataatgtttacagtccagaatgaagac

SEQ ID NO: 33225 - DNA, 579 bp, Artificial Sequence
  Description of Artificial Sequence: Synthetic coding sequence
atggccgcggagccagtggaggataattgcattaattttgttgctatgaagttcatcgataataccctgtactttattgccgaggacgacgagaacctggaaagcgactactttggtaagcttgagtccaaactgtccgtgatccggaatttgaacgaccaggtgttgtttattgatcagggtaaccgcccgctgtttgaggatatgacagactcagactgtcgtgataatgcaccacgaaccatcttcataatctccatgtacaaagacagccagccacgaggtatggcggtgacaatcagcgtgaagtgcgagaagataagtaccttatcctgcgagaataagataatcagtttcaaagaaatgaatccacccgataacatcaaggacaccaagtcggacattatcttttttcagcgctcagtgccgggacacgacaacaagatgcagtttgagtcatctagttatgagggatacttccttgcgtgtgaaaaggaacgtgatttattcaagctgatactgaagaaggaggatgagctgggtgatcggagcattatgtttaccgtgcagaacgaggac

SEQ ID NO: 33226 - DNA, 579 bp, Artificial Sequence
  Description of Artificial Sequence: Synthetic coding sequence
atggccgccgagcctgttgaagataactgtatcaactttgtcgcaatgaagttcatcgataataccctctacttcatcgccgaggacgacgaaaatcttgagagcgactacttcgggaagctggaatcaaagttgagtgtcatccgcaatctcaacgatcaggtgctgttcatcgatcaagggaatcgccccttgtttgaagatatgaccgattcggactgcagagacaacgctccacggaccatcttcattatctccatgtacaaggattcgcagccgagaggaatggctgtgactatcagcgtcaagtgcgagaagataagcacgctgtcgtgcgaaaacaagatcatttcgttcaaggagatgaacccaccagataacatcaaagacactaagtctgacattatcttctttcagcggagcgtgccgggacatgataacaagatgcagtttgagtccagctcttacgaaggctacttcttggcatgcgagaaggagcgcgacctgtttaagctgattctgaagaaggaggacgaactcggggatcggtccatcatgttcaccgtgcagaatgaagat

SEQ ID NO: 33227 - DNA, 579 bp, Artificial Sequence
  Description of Artificial Sequence: Synthetic coding sequence
atggctgcagaacctgttgaggataattgtatcaattttgtcgcgatgaagtttattgataatactctgtactttattgctgaagatgacgaaaaccttgaatccgactactttggaaagttggaatccaaactttcagtgattaggaacctcaacgatcaagtgcttttcatagatcaaggtaaccgcccgctgtttgaggacatgaccgactcggattgccgggacaacgccccgcgaaccattttcatcatatctatgtacaaggactcacagcctcgcggaatggcagtgaccatctccgtgaagtgcgagaaaatctcaaccctgtcttgtgaaaacaagataatctcattcaaggagatgaatccacctgataacataaaagatactaaatcagacattatcttttttcaaagaagcgtgccagggcatgacaacaaaatgcaattcgaatcctcctcctatgagggctacttcctggcatgtgagaaagagagagatctctttaaacttatactgaagaaggaagatgaattgggtgatcgctccatcatgttcactgttcagaacgaggat

SEQ ID NO: 33228 - DNA, 579 bp, Artificial Sequence
  Description of Artificial Sequence: Synthetic coding sequence
atggcggccgagccggtggaagataattgcataaacttcgttgccatgaaattcatcgataacaccctgtacttcattgccgaagacgacgagaatctcgagtctgactacttcgggaagctggagtctaagctttctgtgattcgtaatctgaatgatcaggtgctgtttatcgaccaggggaataggcccctctttgaagatatgaccgattctgactgtagggacaatgcaccccgaaccatattcataatttctatgtacaaagattcacagccacggggtatggccgtgaccattagtgttaagtgcgaaaaaatttctacactttcttgcgagaacaaaatcatttctttcaaggaaatgaatcctcccgacaacattaaagacaccaaaagtgacattattttcttccagcgatccgtccctggtcatgataataagatgcaattcgaaagtagttcctacgagggctacttcctggcatgtgaaaaggagagggatctgttcaagctcatcctcaagaaagaagacgaactcggtgatcggtccattatgttcacagtgcagaatgaagat

SEQ ID NO: 33229 - DNA, 579 bp, Artificial Sequence
  Description of Artificial Sequence: Synthetic coding sequence
atggccgcagaacccgtcgaagataactgtattaattttgtggctatgaaatttattgataatacactgtactttatcgctgaggatgacgagaaccttgagtccgactattttggcaaactagagagtaagctcagcgtgatccgcaatctgaatgaccaggttttatttattgaccaggggaacaggccgttgttcgaagacatgaccgactcagattgtcgcgacaacgctcctagaacaatctttattatctcaatgtacaaagatagccagccacgaggcatggccgttacaatttccgtgaaatgcgagaagattagcacattaagctgtgaaaacaaaatcatctcattcaaggagatgaatcctcctgacaacattaaagatactaagagtgacattatcttcttccagcggtcggtgccagggcacgataataagatgcagttcgagtcctccagctatgagggttattttctggcctgcgaaaaggagagagacctattcaagctgattctcaaaaaagaggatgagcttggagacaggagtatcatgttcacagtccaaaatgaagat

SEQ ID NO: 33230 - DNA, 579 bp, Artificial Sequence
  Description of Artificial Sequence: Synthetic coding sequence
atggccgcagaaccggtcgaagacaactgcatcaacttcgtggcgatgaagttcattgataatacgctttacttcatcgctgaagacgatgaaaacctggagtcggactacttcggtaaactggaatcgaaactttcggtgatcagaaatctgaatgaccaggttctcttcatcgaccaaggaaatcgcccgctgtttgaggacatgaccgatagtgattgccgagacaatgcgccgagaaccatctttatcatcagcatgtacaaggactcccagccacggggcatggcagtgactatcagcgtgaagtgcgagaagatctccaccctctcgtgtgaaaacaagattatctcattcaaggaaatgaatccaccagacaacatcaaagacaccaagtccgacatcatcttcttccaaagatcggtcccaggtcacgacaacaaaatgcaattcgaatcgtcgagctacgaaggatatttcctcgcttgcgaaaaagagcgcgatctttttaagctcatcctgaaaaaggaggatgaattgggcgaccgctcgattatgtttaccgtgcagaatgaggac

SEQ ID NO: 33231 - DNA, 579 bp, Artificial Sequence
  Description of Artificial Sequence: Synthetic coding sequence
atggcagccgagccggttgaggataactgtatcaatttcgtcgcaatgaagttcattgataacactctttactttattgcggaggacgatgaaaacctggagtcagattactttggcaaactggaatcgaaactcagcgttattaggaatcttaatgatcaagtgttgtttattgatcagggtaacagaccgctgtttgaggatatgaccgactcggactgcagagacaatgcacccagaactatctttatcattagcatgtacaaagattcgcagcctcgtggaatggcagtgacgatttcagtgaaatgtgaaaagataagcaccctgagctgtgagaacaagattatctcgtttaaggaaatgaatcctccagataacattaaggacactaagtccgatatcattttcttccagcgatcggtgcctggccacgacaataagatgcaatttgaatcgtcatcatatgaaggatacttcctcgcatgtgaaaaggaaagagatcttttcaaacttattcttaagaaagaggatgaactgggagatagatcaatcatgtttactgtccagaacgaggac

SEQ ID NO: 33232 - DNA, 579 bp, Artificial Sequence
  Description of Artificial Sequence: Synthetic coding sequence
atggctgcggagccggtcgaagacaactgtatcaatttcgtggctatgaagttcatcgacaacactctgtattttatcgccgaagatgatgaaaacctggaaagcgactattttggtaagttggaaagcaagctgagcgtcattcgcaacctgaatgatcaagtactctttatcgaccagggcaaccggccgctgttcgaggatatgactgattctgattgtcgtgataatgcccctcgcacaatcttcattatctccatgtataaggatagccagccacgaggcatggccgtcaccatttctgttaaatgtgagaaaataagcaccttgagctgcgaaaataaaattatcagcttcaaagaaatgaaccctccggataacattaaagacacgaaatccgacatcatcttcttccagcgcagcgtgcccggtcacgataacaagatgcagtttgagtccagtagttacgaaggctatttcctggcctgcgagaaggagcgcgacctgttcaaactcatcctgaaaaaagaagacgagctgggcgatagatctatcatgtttaccgtgcaaaatgaggat

SEQ ID NO: 33233 - DNA, 579 bp, Artificial Sequence
  Description of Artificial Sequence: Synthetic coding sequence
atggcagcggaacctgtggaggacaactgtataaactttgtggccatgaagttcattgacaataccctttacttcattgcagaggatgacgaaaaccttgaaagcgattacttcggcaagctcgagtcgaagttgtctgtgattaggaatctcaacgatcaggtccttttcattgaccaaggcaacagacctctgtttgaggatatgaccgatagcgattgccgagacaatgcaccccgaactatctttatcatttcgatgtataaggattctcaaccgcgcggaatggcagtgactatttcagtgaagtgcgaaaagatatcaaccttgagctgtgaaaacaagattatcagtttcaaggagatgaatcccccggataacattaaggacaccaaaagcgacattatcttttttcagcggagcgtccctggtcatgataacaagatgcaatttgagtctagctcgtacgagggatactttcttgcttgtgaaaaggaacgggacctgtttaaacttattctgaagaaagaggatgaactcggcgatagatccattatgtttactgtccagaatgaagat

SEQ ID NO: 33234 - DNA, 579 bp, Artificial Sequence
  Description of Artificial Sequence: Synthetic coding sequence
atggcagccgagccagtggaggacaactgcatcaacttcgtggcgatgaaattcatcgataacactctgtactttatcgcggaagatgacgaaaatctggaatcagactacttcggaaaacttgagagcaagctgtcagttatcagaaacttgaatgatcaagtcctcttcatcgaccagggaaatagaccgctgttcgaagatatgactgactcggattgccgcgacaacgccccccgcaccatctttatcatcagcatgtataaggactcccagccgcgcggaatggccgtgactatttccgtgaaatgcgaaaagatctcgaccctctcctgtgagaacaaaattatctccttcaaggagatgaaccctccagacaatattaaggacacgaagtctgatattatcttcttccagcggagcgtgccgggccacgataataagatgcaattcgaatcgagctcgtacgaagggtactttctggcttgcgagaaggaacgggacctgttcaagctcatcctgaaaaaggaggatgaactcggtgacaggtcaatcatgtttaccgtccagaacgaggac

SEQ ID NO: 33235 - DNA, 579 bp, Artificial Sequence
  Description of Artificial Sequence: Synthetic coding sequence
atggctgccgagcccgtcgaagacaattgcatcaacttcgtggcaatgaaatttatcgataataccctctatttcattgccgaggacgacgaaaatctcgagtctgattattttgggaaattggaaagcaagctgagcgttatccgaaatttgaacgatcaggtgctgttcatcgaccaaggaaaccgcccgttgtttgaggacatgaccgactccgattgccgagacaatgcaccgaggacaattttcatcatttcgatgtacaaggactctcagccccgtggtatggctgtgacaatctccgtgaagtgtgagaaaatatcgaccctgtcttgcgaaaataaaatcatatcatttaaagaaatgaaccccccggataatattaaggacacgaagtcagacataattttcttccagcgttcagtgccgggtcacgacaataaaatgcagttcgaatcgtccagctatgaaggctacttcttggcgtgtgagaaagagagggacctgtttaagctgatcctcaagaaagaggacgaactaggcgacagaagtatcatgtttacagtgcagaacgaagac

SEQ ID NO: 33236 - DNA, 579 bp, Artificial Sequence
  Description of Artificial Sequence: Synthetic coding sequence
atggccgccgagccagttgaggacaactgcatcaatttcgtggccatgaaattcatagacaatacactgtatttcatcgccgaagacgacgagaatctggaaagcgattatttcggaaagttggagagtaagctgagcgtgatacgcaatttgaatgaccaggttttgtttatagaccaagggaataggccactgtttgaagatatgaccgatagcgactgccgcgataatgcccctcggaccatctttatcatttcaatgtacaaggactcacaaccccgcggcatggcagttaccatctcagttaagtgcgaaaagatctctacactgtcatgcgagaataaaatcatttccttcaaggagatgaatcctcccgacaacatcaaagataccaagtccgatattatcttcttccaacgctctgtaccgggacacgacaataaaatgcagtttgagagttctagctatgaggggtatttcctcgcctgtgaaaaagaaagagaccttttcaagctgattcttaaaaaagaggacgagttgggtgatcgctccataatgtttacagtgcagaacgaggat

SEQ ID NO: 33237 - DNA, 579 bp, Artificial Sequence
  Description of Artificial Sequence: Synthetic coding sequence
atggccgctgagcctgtggaagataactgtatcaattttgtcgctatgaagtttatcgataacacactgtattttatcgcagaagatgacgagaacctagaatcagattactttggaaagttagagagtaagttgtcagttataaggaacctcaacgaccaggtcctctttatcgaccaaggtaaccgacctctgtttgaagatatgactgatagcgactgtagggataacgctccccggacaatctttatcattagcatgtacaaagactcccaacccagaggcatggcagtgactatcagcgtgaagtgcgagaaaatctccacactgagctgtgagaacaagattatcagctttaaggaaatgaacccaccggacaatatcaaggatactaaaagtgacataatcttctttcaaagatctgtccccggacacgacaacaagatgcagtttgagtccagttcgtatgagggctattttcttgcttgcgagaaagagagagaccttttcaaactgatacttaagaaagaagatgagttgggggatcgatccatcatgttcaccgtccagaacgaagat

SEQ ID NO: 33238 - DNA, 579 bp, Artificial Sequence
  Description of Artificial Sequence: Synthetic coding sequence
atggctgcagaaccagttgaagataattgtattaattttgtagctatgaaatttattgataatacactttattttattgctgaagatgacgaaaatcttgaaagtgattattttggaaaattagaaagtaagctcagtgttattcgtaaccttaatgatcaagtactctttattgaccaaggaaatagacctttatttgaagatatgacagattcagattgtagagataatgcaccaaggactatatttattattagtatgtataaagactcacaaccaagaggtatggctgtaacaatatctgttaaatgtgaaaagattagtacactttcatgtgaaaataaaattatatcttttaaggaaatgaatccaccagataatataaaagatacaaaaagtgatattatattctttcaacgttcagtaccaggtcatgacaataaaatgcaatttgaaagtagttcttatgaaggatattttttagcatgcgaaaaagaaagagacctttttaaattaattttaaaaaaagaagatgaactaggagatagaagtattatgtttacagttcaaaatgaagat

SEQ ID NO: 33239 - DNA, 579 bp, Artificial Sequence
  Description of Artificial Sequence: Synthetic coding sequence
atggcagctgaaccggtggaggacaattgtattaactttgtggccatgaagttcatcgacaatacgctgtacttcattgctgaggatgatgaaaacctcgaatccgactatttcggaaaactcgagagcaaactctctgtgatccgcaaccttaacgatcaagtgctgtttatcgaccaaggtaatcggccgctgtttgaggatatgaccgactcggattgccgggacaacgcgccgcgtactatcttcatcatttccatgtacaaggacagccaacctcgggggatggcggtcactatttccgtgaagtgcgagaaaatctcgactctgtcatgcgagaacaagatcatctccttcaaagaaatgaacccgccagacaacattaaggacactaagagcgacatcatctttttccaaaggtccgtgccaggacacgacaacaaaatgcaattcgaaagctcgtcgtacgaaggatacttcctcgcgtgcgaaaaggaaagagatttgttcaaactgatcctgaagaaggaggacgaactgggagatcggagcatcatgttcaccgtccaaaacgaagat

SEQ ID NO: 33240 - DNA, 579 bp, Artificial Sequence
  Description of Artificial Sequence: Synthetic coding sequence
atggccgccgaaccagttgaagacaattgtatcaactttgtggctatgaaatttatcgataatacactctacttcatcgctgaggacgatgagaacctagaatctgattacttcggtaagttggagagcaagctgagcgtaattcggaatctgaatgatcaagtacttttcattgatcagggaaaccgcccattattcgaggatatgacagattcagactgtagagataacgctccgcgaaccatctttataatttcaatgtataaggatagccagccccggggcatggcagtgactatttctgtgaagtgtgagaaaatctctaccctgtcgtgcgaaaataagataattagctttaaggagatgaaccccccggacaacattaaagatacgaagagcgacatcatcttcttccagcgatcggtccctggacatgacaataaaatgcaattcgagagctcaagctacgaaggctatttcctagcttgcgagaaagaacgtgacctgtttaagcttatccttaagaaggaggacgagttgggcgatcggtccattatgtttaccgtgcagaacgaagac

SEQ ID NO: 33241 - DNA, 579 bp, Artificial Sequence
  Description of Artificial Sequence: Synthetic coding sequence
atggctgcagaacctgtcgaagacaattgcattaatttcgtcgctatgaagtttatcgataatacactttattttatcgccgaagacgacgaaaacctggagtctgattacttcggcaagctggagagtaagttgagtgttataagaaacctgaacgaccaggtcctcttcatcgaccagggaaatcggcccctgtttgaggatatgaccgacagcgactgccgcgacaacgcccctcggactatctttatcataagtatgtacaaggactctcagcctcgaggaatggctgtgactatttcagtgaaatgcgagaagattagcactctgtcttgtgagaacaaaatcatttcattcaaagagatgaaccctcctgataacatcaaagatactaagagtgacataatcttctttcagcggtccgtgcctggccacgacaacaaaatgcagttcgaaagttcttcctacgagggttactttctggcgtgtgaaaaagaacgcgacctgtttaagctgatactcaaaaaggaagacgagttgggtgacagatccattatgttcacagtgcagaatgaagat

SEQ ID NO: 33242 - DNA, 579 bp, Artificial Sequence
  Description of Artificial Sequence: Synthetic coding sequence
atggctgccgagcccgtggaagataattgcataaattttgtggccatgaaattcattgataatacgctctatttcattgccgaggatgatgaaaatcttgaatcagattatttcggaaaattggagtcaaaactcagtgtgattagaaacctgaatgatcaggttctatttatcgatcaggggaatagacccctattcgaagatatgactgatagtgattgccgagacaacgctccacggactatctttataatttctatgtataaagattcacagcccagggggatggcagtgacaattagtgtgaagtgtgagaaaatatccacacttagttgtgagaataaaataatctcttttaaagaaatgaaccccccagataacatcaaagatactaaatccgatatcatttttttccaaagaagtgtaccaggacatgataataaaatgcagtttgaatccagttcatacgaagggtatttcctcgcctgtgagaaagaaagagatctcttcaaactgatcctcaagaaagaagatgaactaggagacaggagtatcatgttcactgttcaaaatgaagac

SEQ ID NO: 33243 - DNA, 579 bp, Artificial Sequence
  Description of Artificial Sequence: Synthetic coding sequence
atggcggcggaaccggtggaagataattgtatcaatttcgtcgctatgaagttcatcgacaacactctttacttcatcgccgaggacgatgagaatctcgaatctgactacttcggaaaactcgagtcgaaactgtcagtcatccgtaacctgaacgaccaggtgttgtttatcgaccaggggaaccggccactgttcgaagatatgaccgacagcgactgccgggataacgcccctcgcacgatcttcatcatctcgatgtataaagactcccaaccacgcggcatggcggtgaccatttcagtcaaatgcgaaaagatcagcacgctgtcctgcgagaacaagatcatctctttcaaggaaatgaacccgccggacaacattaaggatacgaaatccgacataatctttttccagagatccgtgcccggccacgacaacaagatgcaatttgaatcctcgtcctacgaggggtactttctcgcgtgcgagaaggaaagagatcttttcaagctgatccttaagaaggaagatgagctgggtgaccggagcatcatgttcactgtgcaaaatgaggat

SEQ ID NO: 33244 - DNA, 579 bp, Artificial Sequence
  Description of Artificial Sequence: Synthetic coding sequence
atggctgccgaacctgttgaagataattgtattaactttgtcgccatgaagtttattgacaacacgctttactttattgcggaagatgacgaaaacttggagtcggactattttggtaaactggaatctaagctgtcggtcattagaaaccttaatgatcaagtgctgtttatcgaccagggcaatcggccactcttcgaagatatgaccgactcagactgtagagacaacgcacctcggacgattttcatcattagcatgtacaaggattcccaacctcgtggaatggccgtcaccatctcggtaaagtgtgagaagatcagtactttgtcatgcgagaataagatcatttcgttcaaggagatgaacccacccgataacattaaagatactaagtccgatatcattttcttccaacgctcagtgcccggacatgacaacaagatgcaatttgaaagctcctcgtacgaaggttactttctcgcgtgcgaaaaggagcgagatcttttcaagctcattttgaaaaaagaagatgaacttggagataggtcgataatgttcaccgtgcagaacgaggat

SEQ ID NO: 33245 - DNA, 579 bp, Artificial Sequence
  Description of Artificial Sequence: Synthetic coding sequence
atggcagccgagccagttgaggataactgtataaacttcgtggcgatgaaattcatagataataccctgtactttattgcagaagatgacgaaaatctcgaaagcgactactttggaaagctggaatccaagctgtcagtcattcgaaacctcaatgatcaggttctgtttattgaccaaggtaataggcctttgttcgaggacatgaccgattcggattgccgcgataatgcaccaaggactatattcatcatttccatgtataaagattctcaaccacgcggaatggccgtgaccatttccgtgaagtgtgagaaaatcagcactctgtcctgtgagaacaagatcatttcctttaaagagatgaatccgccagacaacatcaaagacacgaagtcggacattatcttcttccaaagatccgttcccgggcatgataacaaaatgcagttcgaaagctcatcatacgaaggttactttcttgcatgcgaaaaggaaagagatctgtttaagctgattttgaagaaggaggacgagctcggagataggtcaatcatgtttactgtccagaacgaggat

SEQ ID NO: 33246 - DNA, 579 bp, Artificial Sequence
  Description of Artificial Sequence: Synthetic coding sequence
atggctgccgagcccgtggaggataactgtatcaatttcgtagccatgaagttcatcgacaatacactgtacttcattgctgaggatgacgagaacctggaaagcgactatttcgggaagcttgaatctaagctgtcagtgatccgcaacctgaacgatcaggttctttttattgatcaaggaaatagaccactttttgaagacatgaccgattcggactgtcgcgataatgctccacggactatcttcatcattagcatgtacaaggactctcaacccaggggcatggccgtcactatctcggtgaagtgcgagaagatctccaccctgagttgcgagaacaaaatcatctctttcaaagagatgaacccacccgataatatcaaagacacaaaaagtgatataatcttcttccagcgctccgtgcccggacacgacaataagatgcagtttgagtcttccagctacgagggatattttttggcatgtgaaaaggaacgggatctgtttaagctgattctaaaaaaggaggacgaactgggcgaccgtagcattatgttcactgtccagaacgaggat

SEQ ID NO: 33247 - DNA, 579 bp, Artificial Sequence
  Description of Artificial Sequence: Synthetic coding sequence
atggccgcagagccggtggaggacaactgtatcaactttgtggccatgaaattcatcgacaacaccctgtactttattgctgaggacgacgagaatctcgaatccgattacttcggcaagctggagtccaagctgtccgtaatccgcaacttgaatgaccaagtgctcttcattgatcagggaaataggccactgttcgaagatatgactgactcggattgccgagacaatgctccgagaaccatctttatcatatcgatgtacaaagacagccagccaagaggaatggcggtaaccatctcggtgaagtgcgagaaaatctctactcttagctgcgagaataagatcatctcgttcaaagaaatgaaccctccggacaacattaaggataccaagtccgatatcatctttttccagcgctcggtgcctggtcatgataacaagatgcaatttgaatcatctagttatgaaggatacttcctggcatgcgaaaaagaacgcgacctgttcaagctcatcctgaagaaggaagatgagttgggcgatcggtcgattatgttcactgtgcagaacgaagat

SEQ ID NO: 33248 - DNA, 579 bp, Artificial Sequence
  Description of Artificial Sequence: Synthetic coding sequence
atggccgctgaacccgtggaagataattgcatcaattttgtggcgatgaagttcattgataacactctctacttcatcgcagaggatgatgaaaacttggaatcggactactttggtaaactggaaagcaaactgtcagtgattcgcaatctgaacgatcaggtccttttcatcgaccagggaaatcgtccgctgttcgaagatatgaccgactccgattgccgagacaacgccccgcgcaccattttcattatcagcatgtataaagactcccagcctagagggatggcagtaactatctcagtaaaatgcgaaaagatatcgactctcagctgtgagaataagattatctcatttaaggagatgaacccccctgacaacatcaaggacaccaagtctgacatcattttcttccaacggtccgtcccaggccacgacaacaagatgcagtttgagtcgagctcatacgagggatacttcctggcctgtgagaaggaaagggacttgtttaagttgatcctgaaaaaggaggacgaacttggtgacagatcgatcatgttcacggtccaaaacgaggac

SEQ ID NO: 33249 - DNA, 579 bp, Artificial Sequence
  Description of Artificial Sequence: Synthetic coding sequence
atggcggccgaaccggttgaagacaactgtataaattttgttgccatgaaatttattgataataccctgtactttattgcggaggacgacgagaacctggagtcggattacttcgggaagctagaatctaagttgagtgtcatccgaaacctgaatgaccaagtcctttttatcgatcaaggaaatcgacctctgttcgaggacatgaccgactcagattgcagggacaatgcaccacgaaccatttttataatcagtatgtataaggactcccagccgcggggtatggcagtcaccattagcgtaaagtgtgaaaaaatcagtaccctatcgtgtgagaataagatcatctcctttaaggaaatgaaccctcccgacaatatcaaagacactaagtcggacatcatttttttccaaagatcggtaccaggtcatgataacaagatgcaattcgaatcttcctcatatgaaggttacttcctcgcatgcgaaaaggaacgggatttgttcaagctaatcttgaaaaaagaggatgagcttggtgatcgtagcatcatgtttacggtacagaacgaggac

SEQ ID NO: 33250 - DNA, 579 bp, Artificial Sequence
  Description of Artificial Sequence: Synthetic coding sequence
atggccgccgagccagtggaagacaactgcataaactttgtggctatgaaatttattgacaataccctgtatttcattgctgaagacgatgagaacctagaatccgactattttggtaaactggagtccaagctatccgtgattcgaaaccttaatgatcaagtcttgttcatcgaccaggggaatcggccgctcttcgaagacatgaccgacagcgactgtcgggataacgccccacggactatattcattatttcaatgtacaaggacagccagccaagagggatggccgtgacaatcagcgtgaagtgtgagaagatttcaacacttagctgcgagaacaaaataatcagtttcaaggagatgaatccccctgataatattaaggacacaaaatcagacatcatattttttcagcggtccgtgcctgggcatgataacaagatgcagttcgaatccagctcctacgagggttatttcctggcctgtgaaaaggaaagggacttattcaagctgattctcaagaaggaagacgagctgggtgataggtcgatcatgtttacggtgcagaacgaagac

SEQ ID NO: 33251 - DNA, 579 bp, Artificial Sequence
  Description of Artificial Sequence: Synthetic coding sequence
atggcagcagaaccagtagaagacaattgtattaatttcgtagctatgaagtttattgataataccctctactttatcgcggaggacgatgaaaatttagaaagcgactattttggaaagcttgaatcaaagctttcagtaattcgcaatctcaatgatcaagtattgttcatcgatcaaggaaatagaccgctctttgaagacatgacagattccgattgtcgcgataatgcaccgcgaacgatttttatcattagcatgtataaagattcccagccacgcggaatggcggttaccatttctgttaaatgcgaaaaaattagcacactctcttgcgagaataaaattattagttttaaagagatgaatccgccagacaatatcaaagatacaaaatctgatattattttttttcagcggtcggtaccgggacatgataacaagatgcaatttgaatcgtcgtcttacgaaggctacttcttagcctgtgaaaaagaaagagatctgtttaagttgattctgaagaaagaagatgagttgggagatcgtagcattatgtttacagtacaaaatgaggat

SEQ ID NO: 33252 - DNA, 579 bp, Artificial Sequence
  Description of Artificial Sequence: Synthetic coding sequence
atggcagctgagcccgtagaggataattgcatcaatttcgtggctatgaagtttatagataacactctttactttatcgctgaagatgatgaaaacctggaatccgattacttcgggaaactcgaatcaaaactgtcggtgatccggaaccttaatgatcaggtgttgttcatagatcagggaaaccgaccactcttcgaagatatgacagattcagattgccgggataacgctcctagaactatcttcataatcagtatgtacaaagacagtcagcctagggggatggcagtgacaatcagtgtgaaatgcgagaagatctctactctttcctgtgaaaataaaataatctcctttaaagaaatgaatccaccagataacataaaagatactaaatcagatatcatattctttcagcgatccgtccctgggcacgataataaaatgcagttcgaatcttcatcctatgagggatacttcctcgcctgcgaaaaggaacgcgacctctttaaactaatactcaagaaggaagatgaactcggagatcggtccatcatgtttactgtgcagaatgaagac

SEQ ID NO: 33253 - DNA, 579 bp, Artificial Sequence
  Description of Artificial Sequence: Synthetic coding sequence
atggcagccgaacctgtggaggataattgtataaacttcgtggctatgaagtttatcgataataccctttactttattgcagaggacgatgaaaaccttgaatccgattactttggcaagctggagtcaaaactttcagtcattagaaacctgaatgatcaggtcctgtttatcgatcaagggaaccgcccgctctttgaggatatgactgattccgattgcagggataatgccccacggactattttcattatctccatgtacaaggactcacaaccacgaggaatggcagtgacgatctcagtcaaatgtgagaaaatctcgactctttcctgcgagaacaagatcatttcgttcaaggaaatgaaccctcccgataacataaaggataccaaatccgatatcatcttcttccaacgaagcgtccctggtcatgataacaagatgcaattcgagagctcatcctacgaagggtactttctcgcatgtgagaaggaacgcgatcttttcaaacttattctcaagaaggaagatgaattgggggatagatcaattatgtttaccgtgcaaaatgaagat

SEQ ID NO: 33254 - DNA, 579 bp, Artificial Sequence
  Description of Artificial Sequence: Synthetic coding sequence
atggccgctgagcctgtggaagacaattgtattaacttcgtggctatgaagttcatcgataacactctttacttcatcgcagaggatgacgaaaacctggaatccgattacttcgggaagttggaatctaaactctcggtgattcgaaatcttaatgaccaggtgttgttcatcgaccagggaaataggcccctgtttgaagacatgaccgatagtgactgcagagacaatgccccccgcactatcttcattataagcatgtacaaggacagccaacctagaggtatggccgtaactatcagtgttaagtgtgaaaagatatccactctcagttgtgagaataagattataagcttcaaggaaatgaacccgcctgataacatcaaagacaccaaaagtgacatcatctttttccagagatccgttccaggacacgataacaagatgcagttcgagtcgtcctcctatgagggttactttcttgcctgtgaaaaggagagagacttgttcaagctcatcctgaagaaggaggatgaacttggagaccgcagtattatgttcactgtacagaacgaggac

SEQ ID NO: 33255 - DNA, 579 bp, Artificial Sequence
  Description of Artificial Sequence: Synthetic coding sequence
atggccgctgaaccagtcgaggacaattgcattaactttgtggccatgaaattcatagataataccctctacttcatcgctgaagatgacgagaacctggagtcggattacttcggaaagctggagtcaaagttgtcggtcatccgcaacttgaatgatcaggtgctcttcatcgaccagggaaatcggccgttgttcgaggacatgacggacagcgactgccgcgacaatgccccgaggactatctttatcatctcaatgtacaaagatagccaacctcgcgggatggctgtgactatttcggtgaagtgcgaaaagattagcactctctcgtgtgaaaacaaaatcatcagcttcaaagagatgaacccacccgataacatcaaggacactaagtccgacatcatcttttttcaacggagcgtcccgggtcacgacaacaagatgcagttcgagtcctcatcctatgaaggatacttcctggcatgcgaaaaggaacgggatctgttcaagctgatactgaaaaaggaggacgaacttggcgatagatccatcatgtttacggtgcagaacgaagat

SEQ ID NO: 33256 - DNA, 579 bp, Artificial Sequence
  Description of Artificial Sequence: Synthetic coding sequence
atggctgcagaacccgttgaagataattgtattaactttgtcgccatgaagttcattgataataccctctacttcatcgcggaagatgatgaaaatcttgaatctgactattttggaaagcttgagagcaaactgtctgtgattagaaacctcaacgatcaagtgctgtttatagaccagggcaatcggcctctattcgaggacatgacagacagcgattgccgtgataacgctccacgcactatattcatcatcagcatgtacaaggattcacagcctcgtggcatggcagtcaccattagcgtgaagtgcgaaaagatttcaacattgtcctgtgagaataagatcatctccttcaaggagatgaaccctcccgataatataaaggacaccaagtcagatatcatcttttttcagagatctgtacccggacatgataataagatgcagttcgaatcgagctcttatgagggttattttttggcgtgtgagaaagaaagagatctgttcaagcttatcttaaaaaaggaggatgagctcggggaccggagtataatgtttacagtgcagaatgaagat

SEQ ID NO: 33257 - DNA, 579 bp, Artificial Sequence
  Description of Artificial Sequence: Synthetic coding sequence
atggccgcggaaccggtcgaagacaattgtattaattttgtcgcgatgaaattcatcgataacactctgtacttcattgcagaggatgacgagaatctcgagagcgactacttcggtaaacttgagtccaagttatcagtcatccgcaacctgaacgatcaggttctgttcatcgatcagggtaatcggcccctcttcgaagacatgactgacagcgactgcagggacaacgcgccgaggacaatttttatcataagtatgtacaaggactcacaacctcggggcatggcagtcacgatctcagtaaagtgcgagaagatttccacactctcttgcgagaataagatcattagcttcaaggagatgaatcctcctgacaatattaaagatacaaaatctgacatcatcttcttccagcgatccgttccagggcacgacaataagatgcagttcgagagtagttcatacgaaggctattttttggcctgtgagaaagaacgggacctattcaagctgatattgaaaaaggaggatgagttgggagatagatctattatgttcacggtgcagaatgaagac

SEQ ID NO: 33258 - DNA, 579 bp, Artificial Sequence
  Description of Artificial Sequence: Synthetic coding sequence
atggcagcggagcccgtcgaagacaactgtataaacttcgttgctatgaaattcatcgacaacaccctctatttcattgctgaggacgacgagaacctggaaagtgactacttcgggaaactggagagtaagttatccgtcatcaggaacctcaacgatcaggtgctatttatcgatcagggaaaccggccgctgtttgaggacatgaccgatagtgattgtagggacaatgcaccccgaacaatcttcattatctctatgtataaggattcgcagcctcgcgggatggccgtgacaatcagcgtgaagtgtgagaagatatcaaccctttcgtgtgagaataagattataagcttcaaagagatgaatcctccagataatataaaggatacaaaatctgatatcattttctttcagcgatccgttcccggacatgacaacaaaatgcagtttgaaagttcctcttacgagggatatttcctagcctgtgagaaggagagagacttgttcaagctgatcctgaagaaggaagacgagcttggggaccggagcatcatgtttactgtccagaatgaggat

SEQ ID NO: 33259 - DNA, 579 bp, Artificial Sequence
  Description of Artificial Sequence: Synthetic coding sequence
atggcagcggaacccgtcgaggacaattgcatcaacttcgtggctatgaagttcatcgataacaccctgtacttcatcgccgaggacgacgaaaacctggaatcagactacttcggaaagctcgagagcaaactgtctgtgatcaggaatctgaatgaccaagtgctcttcattgaccagggtaatcgcccgctcttcgaagatatgaccgacagcgactgccgcgacaacgcccctagaaccatcttcattatctcgatgtacaaagatagccagcctcggggcatggcggtgaccatctcggtgaagtgtgagaaaatctctacccttagctgcgagaataagatcatctccttcaaggaaatgaacccaccagacaatatcaaggacactaaaagtgacatcattttcttccagcggagcgtccctggccacgacaacaaaatgcaattcgaatcgtcgagctacgagggctactttctggcctgtgaaaaggaacgagatctgttcaagttgattctcaagaaggaagatgagctgggcgaccgcagcatcatgttcacggtccaaaacgaggat

SEQ ID NO: 33260 - DNA, 579 bp, Artificial Sequence
  Description of Artificial Sequence: Synthetic coding sequence
atggcagcagagcccgttgaagacaactgtattaacttcgtggctatgaaatttatagataatacactgtacttcattgccgaggatgatgagaacctggagtctgactacttcggaaaactcgaatccaaattgtcagttatacgtaacctcaatgatcaggttctcttcattgatcagggtaaccgcccattgttcgaggatatgaccgactctgattgtcgtgataatgccccccgcaccatctttattatctccatgtacaaggacagtcagccacgtggtatggctgtaacaataagcgtcaaatgcgagaagatctcaacactgtcttgcgagaataagatcatttcttttaaggagatgaatcctcccgataacattaaagacaccaagtcagatattatcttttttcagaggtctgtgcctggccacgacaacaagatgcaatttgaatccagttcatacgaaggttactttctggcctgtgaaaaagagcgcgaccttttcaaattgatcctcaaaaaggaggacgagttgggtgatagaagcattatgtttaccgtgcagaacgaggat

SEQ ID NO: 33261 - DNA, 579 bp, Artificial Sequence
  Description of Artificial Sequence: Synthetic coding sequence
atggcagctgaacccgtcgaggataactgcatcaacttcgtggcgatgaagtttatcgataacaccctgtacttcatcgccgaagatgatgagaatcttgaatcagactacttcggaaagctggaatccaagctgtcggtgattaggaacttgaacgatcaagtgctctttatcgaccaggggaatcgaccgctgttcgaggatatgactgactccgactgccgcgacaatgctccgaggacgatcttcataatctcgatgtacaaggacagccagccgagaggaatggccgtcactatctctgtgaagtgcgaaaagatctcaactctgtcgtgcgagaataagatcatctcgtttaaggaaatgaacccaccagataacattaaggacaccaaaagcgacatcattttcttccagcggtcggtccccggccacgacaacaaaatgcaatttgagtctagttcatacgaaggatatttcttggcatgtgagaaggaacgcgacctgttcaaattgatccttaagaaagaggacgaattgggtgaccggtctattatgttcaccgtgcagaacgaagat

SEQ ID NO: 33262 - DNA, 579 bp, Artificial Sequence
  Description of Artificial Sequence: Synthetic coding sequence
atggcagcagaaccggtggaggataattgcattaactttgtcgccatgaagtttatcgacaacacgctgtactttatcgctgaggatgatgaaaacctcgaatccgattacttcggaaaattggaatcaaagttgtcggtcattaggaacctgaatgaccaggtgctgttcatcgaccagggcaatcgccccctctttgaggacatgacggacagcgattgcagggacaatgctccgcgcactattttcatcatttcgatgtacaaggattcgcagccacggggaatggccgtgacgatctcagtcaagtgcgagaaaatctccaccctgtcatgtgaaaacaaaatcatctcgtttaaagagatgaatcctccagacaacatcaaggacaccaagtccgacatcatcttcttccagcggagcgtgcctggtcatgacaacaagatgcaattcgaatcatctagctacgagggatacttcctggcttgtgagaaggaaagggatctctttaagctgatcctgaagaaggaggacgaactcggagatcggtcgatcatgttcactgtccagaatgaggac

SEQ ID NO: 33263 - DNA, 579 bp, Artificial Sequence
  Description of Artificial Sequence: Synthetic coding sequence
atggctgctgaaccagttgaggacaattgcattaacttcgtggccatgaagtttatagataacaccctttactttatagcagaggatgacgaaaacctggaatcggattactttggcaagttggagtcgaaactctcagtcattcgcaatcttaatgatcaggtcctcttcatcgatcagggaaaccgtccccttttcgaagatatgaccgacagcgactgtagagacaatgcaccgcgaactatctttatcatttccatgtacaaggattcgcaaccgagaggaatggccgtgaccatcagcgtcaagtgtgaaaagatatctactctgagctgcgaaaacaagatcatctcattcaaagagatgaaccctcctgacaatatcaaggacactaaaagcgacattatctttttccaacggtccgtgcctgggcacgataacaaaatgcaatttgaatcatcctcatatgaaggctacttccttgcatgtgagaaggagagagatctctttaaacttattctgaagaaggaggacgaattgggtgatcgttccatcatgtttactgtgcagaacgaagat

SEQ ID NO: 33264 - DNA, 579 bp, Artificial Sequence
  Description of Artificial Sequence: Synthetic coding sequence
atggcagctgagcctgtggaagataactgcatcaatttcgtcgccatgaagttcatagataatacactgtacttcattgccgaagatgatgagaacctcgaatccgactatttcggaaaattggagtctaagctgtctgtaatacggaacttgaatgatcaggtcttgttcattgatcaaggtaaccggcccctttttgaggacatgacagattcagactgtcgcgacaacgcccctcgaaccatattcatcattagcatgtataaggacagccagccacgcggaatggcagtgacaattagtgtcaaatgtgagaagataagtacccttagctgcgagaacaagatcatctcttttaaggaaatgaacccccctgacaacattaaggacacgaagtccgacataatcttctttcagcgttcagtacccggtcatgacaataagatgcagtttgagtcatcttcgtatgagggctacttcctggcctgtgagaaagagagggacctgtttaagctgatcctgaagaaggaagacgagcttggtgatcgttccattatgttcaccgttcagaacgaggat

SEQ ID NO: 33265 - DNA, 579 bp, Artificial Sequence
  Description of Artificial Sequence: Synthetic coding sequence
atggcagccgaacctgtcgaagataattgcattaactttgttgcaatgaaattcatagacaacaccttgtacttcattgcagaagatgatgagaatcttgaatccgattactttggtaaactggagtcgaaactttcggtgatcagaaacctgaacgatcaggtgttgttcatagaccaaggcaaccgtccactgtttgaagatatgaccgatagcgattgtcgtgataacgcgcctcgcaccatcttcatcataagcatgtacaaggatagccagcctcggggtatggcagtcacgatttcggtgaagtgtgaaaagatcagcacgcttagctgcgaaaacaagattatcagctttaaggaaatgaatcccccagacaatatcaaagacactaaatctgacatcatcttttttcaaagatccgttccaggacatgataacaagatgcaatttgaaagctcctcctatgaaggatactttctcgcctgtgagaaagagcgcgacctctttaagctgattctcaagaaagaagatgaactgggagatcgaagcataatgtttaccgtgcaaaacgaagat

SEQ ID NO: 33266 - DNA, 579 bp, Artificial Sequence
  Description of Artificial Sequence: Synthetic coding sequence
atggctgcagagcctgttgaggataattgtatcaacttcgtcgctatgaaattcatcgataacaccctgtactttatagctgaggatgatgaaaacctggaatccgattatttcggcaaattggagtccaaattgagtgtgatcaggaaccttaatgatcaggtactattcatcgaccagggcaaccggcctctcttcgaagacatgactgattccgattgtagagacaacgctccgcggactatctttataatatctatgtacaaagatagtcagccacgagggatggccgtaactatcagcgtcaagtgcgaaaaaatctctactctcagctgtgagaacaagatcatctcttttaaggaaatgaacccaccagataacatcaaagatacgaagtcagatattatattttttcaacggagtgtgcctggacatgataataagatgcaatttgagtcttcttcctatgaaggctatttcctcgcatgcgagaaggaaagggatctgtttaaactcatcctgaagaaagaagacgaactcggagacaggtcaattatgttcactgttcagaacgaggat

SEQ ID NO: 33267 - DNA, 579 bp, Artificial Sequence
  Description of Artificial Sequence: Synthetic coding sequence
atggcggcggaaccggtagaagataattgtataaattttgttgcgatgaaatttatagataatacgttatattttatagcggaagatgatgaaaatctagaatcggattattttggtaaattagaatcgaaactatcggttatacgaaatctaaatgatcaagtattatttatagatcaaggtaatcgtccgctatttgaagatatgacggattcggattgtcgagataatgcgccgcgaacgatatttataatatcgatgtataaagattcgcaaccgcgaggtatggcggttacgatatcggtaaaatgtgaaaaaatatcgacgctatcgtgtgaaaataaaataatatcgtttaaagaaatgaatccgccggataatataaaagatacgaaatcggatataatattttttcaacgttcggtaccgggtcatgataataaaatgcaatttgaatcgtcgtcgtatgaaggttattttttagcgtgtgaaaaagaacgtgatctatttaaactaatactaaaaaaagaagatgaattaggtgatcgttcgataatgtttacggtacaaaatgaagat

SEQ ID NO: 33268 - DNA, 579 bp, Artificial Sequence
  Description of Artificial Sequence: Synthetic coding sequence
atggctgccgaacccgttgaagataattgcatcaactttgttgcgatgaagttcattgataatacattatatttcatcgccgaagacgatgaaaacctcgagtccgactattttggtaagttggaaagtaagctcagcgtgatccgcaatctgaacgaccaagtgctttttatcgatcagggcaacaggcctttatttgaggatatgacagattccgactgccgggataacgcccctaggactatttttattatcagcatgtacaaggacagccagccaaggggtatggccgtcaccatctctgtgaagtgtgagaagatctctacgctgtcttgtgagaacaaaattatttcatttaaggaaatgaacccgcctgataacataaaggacactaaatcagacatcatatttttccagaggtctgtgcccggccacgacaacaaaatgcagttcgagtctagttcttacgaagggtacttcctggcctgtgagaaagagcgcgatctattcaaactgattctaaagaaagaagatgagctgggcgaccgcagtattatgttcaccgtgcagaacgaggac

SEQ ID NO: 33269 - DNA, 579 bp, Artificial Sequence
  Description of Artificial Sequence: Synthetic coding sequence
atggccgccgaaccagtcgaagacaactgcattaactttgtggcaatgaagttcatcgacaacacactctattttattgccgaggacgatgagaacctggaatcagactacttcggtaaactcgaaagcaagttgagcgtcatcagaaacctcaatgatcaggtactattcatcgaccagggtaacaggccactattcgaggacatgacagattcagactgccgagacaacgccccccgaaccatttttattatttcgatgtataaagactctcaaccccgcggtatggccgtcacaatttcagtgaaatgcgagaagatttcaacgttgagctgcgagaacaaaatcatcagttttaaggaaatgaatccgcccgataatattaaggatacaaagtctgacataattttctttcaacgctctgtccctggccacgataataaaatgcaatttgaatcctcaagctatgaaggctattttctcgcctgcgaaaaggaacgcgacctgttcaagctcatacttaaaaaagaggatgagctcggtgaccgtagcattatgtttaccgtgcagaacgaggac

SEQ ID NO: 33270 - DNA, 579 bp, Artificial Sequence
  Description of Artificial Sequence: Synthetic coding sequence
atggccgctgagccagttgaggataactgcattaattttgtggcaatgaagtttattgacaataccctttactttattgctgaagatgatgagaacttagaatctgactatttcggcaaattggagagtaaactttccgtgattcgcaacctcaatgaccaggttctgttcatagaccaggggaatcgccccctgttcgaagacatgaccgactctgattgcagggataatgctccacgcaccatatttatcatttctatgtacaaggattcccaaccccgtggtatggccgttacaatcagcgtaaagtgcgaaaagatctccacattaagctgtgaaaataagatcatttcttttaaagaaatgaacccccctgacaatattaaggatacaaagtctgatataattttttttcagcgctcagttccaggccacgataacaaaatgcaatttgagtccagcagctatgagggttacttcctggcttgtgaaaaagaacgggatctatttaagctgatcctaaagaaggaggacgagcttggggacaggtccattatgtttactgtacagaacgaggat

SEQ ID NO: 33271 - DNA, 579 bp, Artificial Sequence
  Description of Artificial Sequence: Synthetic coding sequence
atggcagcagagcccgttgaggataactgcataaactttgtggcaatgaagttcattgacaacaccctgtacttcattgcagaggatgatgaaaacctggaaagcgattacttcggcaagctcgagtcaaaactttcggtgatcagaaatcttaatgatcaagtccttttcattgatcaaggcaatcgccctctttttgaagatatgacggactccgactgtagagacaatgcaccccggactatcttcattatctcgatgtacaaggatagccagccgcggggaatggcagtgaccatctccgtgaaatgtgagaaaatctccactctctcttgcgaaaacaagattatcagttttaaggagatgaaccctcctgacaacattaaggataccaaatccgatatcatcttttttcagcggagcgttccggggcatgacaacaagatgcaattcgaatcctcgagctacgaaggctacttcctggcctgcgaaaaagagagggatttgtttaaacttattctgaaaaaagaagatgaactgggtgatcgatcgataatgtttaccgtgcagaacgaagat

SEQ ID NO: 33272 - DNA, 579 bp, Artificial Sequence
  Description of Artificial Sequence: Synthetic coding sequence
atggctgcagaacctgtcgaagacaactgtatcaattttgtggccatgaaatttattgataacaccctatactttatcgctgaggacgatgagaacctcgaatcagactattttggaaagctggagagcaagctcagcgtgatccgcaatctgaacgaccaggtgttatttatcgatcagggaaacaggccgctcttcgaggatatgaccgacagtgactgccgcgacaacgctcctaggacaatttttataatttccatgtacaaagacagccagccccgcggcatggccgtgaccatttctgtgaagtgtgagaaaattagcacactctcttgtgaaaataaaatcattagctttaaagaaatgaatccgcccgacaatattaaggacactaagagcgacatcattttttttcagcggtcagtcccgggccatgacaacaagatgcagttcgaatcctcaagctacgaggggtatttcctcgcatgcgagaaagaaagggacctctttaagcttatccttaaaaaggaggacgaactgggtgatagaagcatcatgtttacagttcagaatgaagac

SEQ ID NO: 33273 - DNA, 579 bp, Artificial Sequence
  Description of Artificial Sequence: Synthetic coding sequence
atggccgccgaacctgtcgaagataattgtataaacttcgtggctatgaaatttatcgacaacacactgtatttcatagcggaggacgacgagaatttggagtcagattacttcggaaagctcgagagtaagctctcagtcatacgaaatctgaacgaccaggttcttttcattgatcaaggcaacagaccactgtttgaggacatgaccgattccgactgtagggataacgctcctagaaccattttcattatatccatgtacaaagactcacaaccccggggcatggcagtgaccatctcagtgaagtgcgagaagatcagcaccctgagctgtgagaacaaaattatcagcttcaaggaaatgaaccctccggacaacatcaaggacacaaaaagcgatatcatattctttcagaggtctgtgccaggacatgataacaaaatgcaattcgaaagctcttcctatgagggatatttcctcgcttgtgagaaagagcgcgatttgttcaagcttatcctcaaaaaggaggacgaactgggtgatcggagtataatgtttacagtacagaatgaagac

SEQ ID NO: 33274 - DNA, 579 bp, Artificial Sequence; identical to SEQ ID NO: 33240
  Description of Artificial Sequence: Synthetic coding sequence

SEQ ID NO: 33275 - DNA, 579 bp, Artificial Sequence
  Description of Artificial Sequence: Synthetic coding sequence
atggccgcagaacccgttgaagataactgtattaacttcgtggccatgaagtttatagataatactctctactttatcgcggaagatgacgagaacttggaatcggactactttgggaagctggagtcgaaactttccgtgatcaggaacctgaacgatcaagtgcttttcatcgatcaaggaaatagacctttgtttgaagatatgaccgacagcgactgtcgggataatgcaccccgcaccatcttcataatctccatgtacaaagactcccagcctagaggtatggcagtgaccatatctgtgaagtgcgagaagatttcgaccctctcgtgtgaaaacaaaatcatctcatttaaggagatgaatccacctgacaatatcaaagacacgaagtcggacataatcttcttccagcgttcggtcccgggacatgacaacaaaatgcaatttgagtcgagcagctatgagggctacttccttgcatgcgaaaaggaacgggatctgtttaagttgattcttaagaaggaggatgagctgggcgatcgttccattatgtttactgttcagaacgaagat

SEQ ID NO: 33276 - DNA, 579 bp, Artificial Sequence
  Description of Artificial Sequence: Synthetic coding sequence
atggctgccgagcccgtggaggataattgcatcaatttcgtggctatgaaattcatcgataataccctttacttcattgctgaggacgatgagaacctcgaatcagattatttcggaaaactcgagtccaaactcagtgtgataagaaacctgaacgatcaagtcctgtttattgaccagggaaataggcccctttttgaagacatgacagatagcgattgtcgggataacgcaccccgaacaattttcattattagtatgtataaagattcccagcctaggggcatggccgtcaccattagcgtgaaatgtgagaaaatttccacactgtcatgcgagaataaaatcatctcattcaaagaaatgaaccccccagacaacataaaggatactaaatcagacatcatattttttcagaggagcgttcctgggcatgacaataaaatgcagtttgaatctagttcgtacgagggatatttcctggcctgtgagaaggaaagggacctgtttaaacttattttgaagaaggaagatgagttaggcgacagatccatcatgttcacagtgcagaatgaggac

SEQ ID NO: 33277 - DNA, 579 bp, Artificial Sequence
  Description of Artificial Sequence: Synthetic coding sequence
atggccgcagaaccagttgaagataactgcataaacttcgtggctatgaaattcatcgataacactttatatttcatcgccgaggatgatgaaaatctagagtccgattattttggaaaacttgaatcaaagttgtcagtcatccgaaaccttaacgatcaagtcctttttatcgatcaaggaaacaggccattgttcgaagatatgacagattccgattgtcgtgataacgcaccccgtacaatttttataatctccatgtacaaggatagtcagccacgaggcatggcggttacaatttccgttaaatgcgaaaaaatcagtaccctgagttgtgagaataaaatcatttcctttaaagaaatgaatccacctgacaatattaaagatacaaaatccgatatcatcttttttcaaaggtcagttcctggacacgacaacaagatgcagtttgaatcgtcttcatacgaaggttatttcctggcatgcgagaaggagagggacttgtttaagttaattctgaaaaaagaggacgaacttggtgaccgttctatcatgttcacagttcagaatgaagac

SEQ ID NO: 33278 - DNA, 579 bp, Artificial Sequence
  Description of Artificial Sequence: Synthetic coding sequence
atggcagctgagcctgtggaagataactgtataaactttgtagcaatgaaattcattgacaacactctttactttattgcggaagatgatgaaaacctggagagcgattactttgggaagctggaatcgaagctgagcgtgatccggaaccttaatgaccaagttctctttatcgatcaaggtaatagaccgctttttgaggacatgaccgactctgattgtcgggacaacgcgcctagaaccatcttcataatctccatgtacaaggatagccagccccggggcatggcagtgactatttcggtcaagtgtgaaaagatttcgacgctgtcctgcgagaataagatcattagctttaaggaaatgaatccaccagataacattaaagacactaagagcgatatcattttctttcaacgttccgtgcctggtcatgataacaagatgcagtttgaaagctcctcgtacgaaggttacttccttgcgtgcgagaaggagagagatttgtttaagctgatcttgaaaaaggaagatgagctcggggatcgctctatcatgtttaccgtgcagaatgaagat

SEQ ID NO: 33279 - DNA, 579 bp, Artificial Sequence
  Description of Artificial Sequence: Synthetic coding sequence
atggccgccgaacctgtcgaggacaactgcattaattttgtcgcaatgaagtttatagataatacgctgtatttcattgctgaagacgatgaaaacctcgaaagcgactacttcggaaagctcgagtcaaaactctcagtgatcagaaatctcaacgaccaggtactgtttattgatcagggtaaccgacccctgttcgaggacatgacggattctgattgtcgggataacgccccccgaaccatctttatcattagcatgtataaagacagccagccaagagggatggcggtaacaataagtgtgaaatgcgagaaaatctcaaccttatcttgtgaaaataagatcatcagctttaaggaaatgaatccccctgacaacatcaaggataccaagtctgacataatcttttttcaacgaagcgtacccggtcatgataataaaatgcagtttgagtcaagctcctatgaaggttacttcctggcctgtgaaaaggagcgagacctgtttaagctcattctgaagaaggaggatgagctgggagaccgctctatcatgtttactgttcagaatgaagac

SEQ ID NO: 33280 - DNA, 579 bp, Artificial Sequence
  Description of Artificial Sequence: Synthetic coding sequence
atggcagctgaacctgtggaagataactgtatcaactttgttgcaatgaagtttatagataatactctttactttatcgcagaggacgatgaaaacctggaaagcgactacttcggaaagctggaaagcaagctgagcgtgatacgaaaccttaatgatcaagtgcttttcatagatcaggggaaccggcctctttttgaggatatgactgactccgactgccgagacaacgcaccaagaaccatcttcataatctcaatgtacaaggatagtcagccgagggggatggcagtgaccatcagcgtgaaatgcgaaaagatttccactctgtcctgtgagaacaagataatctccttcaaagaaatgaatccacccgacaatatcaaggacactaaatcagacattatcttcttccagaggtcggtgcctggtcatgacaataagatgcaatttgaatcctcgtcgtatgagggctactttcttgcctgtgaaaaagaacgggacctgttcaagttgattctgaagaaggaggacgaacttggcgatcggtcaattatgtttaccgtccaaaatgaggat

SEQ ID NO: 33281 - DNA, 579 bp, Artificial Sequence
  Description of Artificial Sequence: Synthetic coding sequence
atggccgcagaacctgtggaagataactgtattaacttcgttgcaatgaagttcattgataacactctctacttcatcgcggaagatgacgagaaccttgaatcagattacttcgggaagctggaatcaaagctgagcgtgattagaaacctcaacgatcaagtcctcttcatcgatcagggtaaccggcctctgtttgaggacatgacggattcggactgtagagacaatgccccaaggaccatcttcataatctccatgtacaaggattcccaaccaagaggcatggccgtcaccatttccgtcaagtgtgaaaagatatcgacgctgtcatgcgagaacaagatcataagtttcaaagagatgaatccacccgataacataaaggataccaagtccgacattatcttttttcagagatccgtgccaggtcatgacaataagatgcaatttgagagctcgtcgtacgaaggatacttcctggcatgtgaaaaggaaagggatctgtttaagctgattctcaaaaaagaagatgaattgggggatcgctccatcatgtttacggtgcaaaacgaagat

SEQ ID NO: 33282 - DNA, 579 bp, Artificial Sequence
  Description of Artificial Sequence: Synthetic coding sequence
atggctgcagagccggtggaggacaactgcattaacttcgtcgccatgaagtttatcgacaacactctgtacttcatcgcggaggatgacgaaaatctcgaatctgattactttggaaagctggagtcgaaactctcagttattcggaacctcaatgaccaggttctgtttatcgaccaaggcaataggccgctgttcgaggacatgaccgatagcgattgtagagataacgctccgcgcactattttcatcatctcgatgtacaaggactcgcagccgcgggggatggcggtgactatctccgtgaagtgcgagaagatcagcactctgagctgcgaaaacaagatcatcagcttcaaggagatgaaccctcccgataacatcaaggataccaagtcggacatcattttcttccagcggtcagtgcctggacacgacaataagatgcagttcgaatcctcgagctacgaaggctacttcctggcatgtgaaaaggagagagacttgttcaagctgatcctgaagaaggaggacgaactcggagatcggtcaatcatgttcaccgtgcagaatgaggac

SEQ ID NO: 33283 - DNA, 579 bp, Artificial Sequence
  Description of Artificial Sequence: Synthetic coding sequence
atggccgctgagcctgtcgaagacaactgcattaactttgtggcgatgaaatttatcgacaacaccctgtacttcatagcagaagacgacgagaatctagaatccgactatttcggcaagttggagagcaaattgagcgtcatccgtaacctgaacgaccaggtcctgtttatcgatcagggcaatcgcccgctgtttgaagatatgactgactctgattgtcgagataacgccccacgtacaatctttataatttctatgtataaggattcccagccccgtggcatggctgttacgatctcagtgaaatgtgaaaagatttccacgctgagctgcgagaataaaatcatcagttttaaagagatgaatcccccagataacatcaaggataccaagagtgacattattttcttccagcggtctgtaccaggccatgacaacaagatgcagttcgaatcctcaagttatgaagggtattttctcgcctgcgaaaaagagagagacctgttcaaactgatcctcaaaaaagaggatgagctgggggaccggtcaataatgttcacggtccagaacgaagat

SEQ ID NO: 33284 - DNA, 579 bp, Artificial Sequence
  Description of Artificial Sequence: Synthetic coding sequence
atggcagccgaaccggtggaagataactgtatcaatttcgtcgcaatgaagtttattgacaacaccttgtactttatagcggaggatgacgaaaatcttgagtccgactacttcgggaagctcgaaagcaaattgtctgtgatcaggaacttgaacgatcaggtgctgttcatcgaccagggtaaccgcccgctctttgaggacatgaccgattcagactgccgagacaatgccccccggaccatcttcattatctcaatgtacaaagattcgcagcctagaggcatggcggtaaccatttcggtcaagtgcgaaaagattagcactctgagttgcgagaacaagatcatctcgttcaaggaaatgaacccaccggataacatcaaggacacgaagtcagacatcatcttcttccaacgctccgttcctggacacgataacaagatgcagtttgaatcttcctcgtacgaaggatatttcctggcttgcgagaaggagcgcgacctgttcaaactgatactcaaaaaagaggacgaactcggagatcgttccatcatgtttactgtgcaaaatgaggat

SEQ ID NO: 33285 - DNA, 579 bp, Artificial Sequence
  Description of Artificial Sequence: Synthetic coding sequence
atggcagccgagccagttgaagataactgtatcaacttcgtggccatgaagtttattgataatactctgtacttcattgcggaggatgatgaaaacctcgaaagcgactatttcggcaagctggaatccaagctgtcggtgatccggaacctgaatgaccaggtcctgttcatcgaccagggaaaccggccactgttcgaggacatgaccgatagcgactgtagagacaacgctccgcggaccatctttatcatcagcatgtacaaagatagccagccgcggggtatggccgtcaccatcagcgtgaagtgcgaaaagatatccactctgtcgtgcgaaaacaaaatcatctcgttcaaggagatgaaccctccggacaacatcaaggacaccaaaagcgacatcatcttctttcaaaggtcggtgccgggacacgacaataagatgcagttcgaatcgtcatcatacgaaggttactttttggcgtgcgaaaaggagcgtgatctgttcaagctgatcctcaaaaaagaagatgaattgggagacagatcgatcatgttcaccgtgcagaatgaagat

SEQ ID NO: 33286 - DNA, 579 bp, Artificial Sequence
  Description of Artificial Sequence: Synthetic coding sequence
atggccgccgaacctgtggaagacaactgtatcaattttgtggccatgaagttcattgacaacacactgtatttcatagcagaggacgacgagaatctagaatctgattacttcgggaaattggaatccaaactgtcagtgattcgcaacctcaacgaccaagtgttgtttatcgatcaggggaatcggccgcttttcgaagacatgactgactcagactgccgggataacgccccaaggacaatttttatcatctctatgtacaaggactctcagccacgggggatggccgtcacaatatctgtgaagtgcgagaaaattagcacactaagttgcgaaaacaaaattatcagcttcaaggaaatgaatccccctgacaatattaaggatacaaaatcagatatcatattctttcagaggtccgttccagggcacgacaacaagatgcaattcgaatcttcatcctatgagggctacttcctcgcctgtgagaaggagagagacttgttcaagctgattctgaaaaaagaggatgaactgggcgacagatcaataatgtttaccgttcagaatgaggac

SEQ ID NO: 33287 - DNA, 579 bp, Artificial Sequence
  Description of Artificial Sequence: Synthetic coding sequence
atggccgccgaacctgtagaagacaattgtattaatttcgtggccatgaaattcatcgataatacactgtatttcatcgcggaggatgacgagaatctggaatccgactacttcggaaagctcgaaagcaagctttctgtgattagaaacttgaatgaccaagtgctcttcattgaccagggtaatcggcctctctttgaagacatgacagactccgattgtcgggataatgcaccaaggacaattttcatcatctccatgtacaaagacagccagcctcgcgggatggctgtgaccatctccgtcaagtgcgagaaaatctccactctttcttgtgagaacaagatcatctccttcaaagagatgaatccccctgacaatattaaggacaccaagagtgatatcatatttttccagcgcagtgtgccggggcatgataacaaaatgcagttcgagtcgagctcttacgagggatatttcctcgcatgtgaaaaagaacgtgatctgtttaaactgatcctaaagaaagaggacgaactcggggacagaagtataatgtttaccgtacaaaatgaagat

SEQ ID NO: 33288 - DNA, 579 bp, Artificial Sequence
  Description of Artificial Sequence: Synthetic coding sequence
atggccgcagagcccgttgaggataactgcatcaattttgtagccatgaagttcattgataatacgctctactttatcgctgaggatgatgagaatctcgagtccgactacttcggtaagctggagagcaaattgtcagtgatccgcaatctgaatgaccaggtgctgttcatcgaccagggaaataggccgttgttcgaggacatgactgatagcgactgcagagacaacgccccgagaaccatctttataattagcatgtacaaggattcacaaccgagaggtatggctgttacgatcagcgtgaagtgcgagaagataagtacgctgagctgcgagaataagattatcagctttaaggaaatgaacccccctgacaacataaaagacacaaagtccgacatcatcttcttccagagatccgttcccggccatgataacaagatgcagttcgaatccagctcttatgagggttattttctcgcttgcgagaaggagagggacctgttcaagctgatcttgaagaaagaagatgagctgggagataggagcatcatgttcacggttcagaatgaagat

SEQ ID NO: 33289 - DNA, 579 bp, Artificial Sequence
  Description of Artificial Sequence: Synthetic coding sequence
atggccgccgaacccgttgaagacaactgtattaattttgtcgccatgaagtttatagataacaccttgtacttcatagccgaagacgacgaaaaccttgaatctgactacttcggtaaactggagtccaagctgtcagtgatcaggaaccttaacgatcaggttctctttatagatcaggggaacagacctttatttgaagatatgaccgattctgactgcagggacaacgcccccaggaccatatttatcatatcaatgtacaaggactctcagccaagagggatggcagtcactatttctgtaaagtgcgagaagataagtaccctcagttgcgagaacaaaatcattagcttcaaggagatgaatccaccagataacatcaaggacacgaagtcagacataattttctttcagcggtctgtgcccggccacgacaacaagatgcagtttgaaagcagtagctacgaggggtacttcctcgcatgcgaaaaggagagggatttgttcaagctcattctgaaaaaggaggacgagctcggagacagaagtataatgttcactgtccagaatgaagat

SEQ ID NO: 33290 - DNA, 579 bp, Artificial Sequence
  Description of Artificial Sequence: Synthetic coding sequence
atggctgccgagcctgtcgaagataactgcatcaactttgtagccatgaaattcatcgataataccctttattttatcgctgaggacgacgaaaatctagagagcgactactttggcaaactcgaatcaaaactatcagtgattcgaaacctgaatgatcaagtgctcttcatcgatcaaggaaaccgacccctgttcgaagatatgacagattctgattgccgagataacgcccccaggactatattcattatcagcatgtacaaagactctcagccccggggaatggccgtcacaatctcggtgaagtgcgagaaaatctcaaccctgtcgtgcgagaacaagatcatctcattcaaggagatgaatcccccagataatattaaagacactaagagtgacattattttttttcagaggtctgtgccaggccacgacaacaagatgcagttcgagtcatcatcttatgaaggttactttctcgcctgtgaaaaggagcgggatctgtttaagctgatcctgaaaaaggaggatgaactgggggacagaagcataatgtttacggtgcaaaatgaagat

SEQ ID NO: 33291 - DNA, 579 bp, Artificial Sequence
  Description of Artificial Sequence: Synthetic coding sequence
atggcggccgagccagtcgaagataattgcatcaactttgtggcgatgaagttcatcgacaacactctttactttatcgccgaggatgacgagaacctggaatccgactacttcgggaaactggagagcaagctgtcggtcatcagaaatttgaacgaccaggtgctctttatcgaccagggaaaccgcccgctgtttgaggacatgaccgactcagactgccgggacaatgccccacgcactattttcatcatcagcatgtacaaagatagccagccacgcggaatggctgtgaccatcagcgtgaagtgcgaaaagatttccactctgtcatgtgagaacaagattatctcgttcaaagaaatgaatccgccagacaacattaaagataccaaatcagacataatcttctttcaacgctcggtccctggccacgataacaagatgcaattcgagtcatcctcgtatgaaggatacttccttgcatgcgaaaaagagcgggatctcttcaagctcatcttgaagaaggaggacgagctgggtgaccgcagcattatgttcacggtgcagaacgaggat

SEQ ID NO: 33292 - DNA, 579 bp, Artificial Sequence
  Description of Artificial Sequence: Synthetic coding sequence
atggcagctgaacctgtggaagataattgtatcaatttcgtggcgatgaagtttatagacaacaccttgtactttatcgccgaggacgatgaaaacctggaatcagattactttggtaaacttgaatcgaagctgagcgtgattagaaacctgaacgatcaagtcctcttcatcgatcagggcaacagacctctttttgaagatatgacggattcagactgtcgggataatgcacctaggacgatctttatcatatcgatgtataaagacagccaaccaagagggatggcagtgactatttccgtgaaatgtgagaagatttcaacgctgtcctgtgagaataagattatcagctttaaggagatgaacccacctgacaacattaaggataccaaatcggatatcattttctttcagcggagcgtgcctgggcatgacaataagatgcagtttgaatcgtcatcatacgaggggtacttccttgcatgcgaaaaggagcgagatctgtttaagttgatactcaaaaaggaggacgaacttggcgatcgctccattatgttcactgttcagaacgaggat

SEQ ID NO: 33293 - DNA, 579 bp, Artificial Sequence
  Description of Artificial Sequence: Synthetic coding sequence
atggcagcagagcccgtggaggacaactgcattaatttcgtcgcgatgaagttcatagacaataccctatacttcatcgccgaggacgatgaaaacctcgagtccgattattttgggaagcttgagagtaagttgtctgtcatccggaatctcaacgaccaggttttattcattgatcagggcaatcgccccttgttcgaggacatgacagattccgactgccgtgataatgcccctcgaacaatatttatcatttctatgtacaaagattcacagccaaggggcatggccgtgaccatctctgttaaatgtgagaagatctcaacactgtcctgcgagaacaaaatcatcagtttcaaggagatgaacccaccagacaacatcaaggacacaaagagcgatattatttttttccagagatcagtgcctggccacgacaacaaaatgcagttcgagtctagctcgtacgaagggtacttcctggcctgcgaaaaggagcgagacctcttcaagctgatccttaagaaggaggacgagctcggagataggtctattatgttcacagtgcagaatgaagac

SEQ ID NO: 33294 - DNA, 579 bp, Artificial Sequence
  Description of Artificial Sequence: Synthetic coding sequence
atggccgccgagccggtcgaagataattgcatcaattttgtggcaatgaagtttatcgacaacaccctctactttatcgcggaggacgacgaaaaccttgagagcgactacttcggcaaactggaatcaaagctgagcgtaatcaggaacctgaatgaccaggtgctgttcattgaccaagggaatcggccgctgttcgaggatatgaccgattcagactgccgggacaatgccccgcggactatcttcatcatcagtatgtacaaggactcgcagccacgcggtatggcagtgaccatttccgtgaaatgcgagaaaatctccacgctgtcgtgtgaaaacaagatcatcagcttcaaggagatgaacccgccagacaacatcaaagatactaaatctgacataatcttcttccaacgctcggtgccgggccacgacaataagatgcagttcgagagctcctcgtatgaaggctacttcctggcttgtgagaaggagcgtgacctcttcaaactgatcctgaagaaggaagatgagctcggagatagatccattatgtttactgtgcagaacgaggac

SEQ ID NO: 33295 - DNA, 579 bp, Artificial Sequence
  Description of Artificial Sequence: Synthetic coding sequence
atggcagcagaaccagttgaagataactgcatcaatttcgtggccatgaagtttatcgacaatacgttgtactttatcgctgaggacgacgagaatctggaaagcgattattttggaaagctagagagcaagctgtccgtcatccggaaccttaatgatcaggtgctgttcatcgatcagggcaaccggccactctttgaggacatgactgatagcgattgtagagataacgctcctcgaactatcttcatcatttctatgtataaagactcacagccaaggggaatggctgtgaccatcagcgtgaagtgcgagaagatttccaccctgtcttgcgagaacaaaattatcagcttcaaggaaatgaaccccccagacaatattaaggacaccaagtcagatatcatcttcttccagaggagcgtcccaggacacgacaataaaatgcagtttgagagcagtagttacgaaggatatttcttggcctgcgaaaaggaaagggatctgtttaaactgatactcaagaaagaagatgagctgggcgataggagtatcatgttcaccgtacagaacgaggac

SEQ ID NO: 33296 - DNA, 579 bp, Artificial Sequence
  Description of Artificial Sequence: Synthetic coding sequence
atggccgcagagcctgttgaggacaactgtattaatttcgtggcaatgaaatttatcgataacaccctgtactttatcgctgaggatgatgagaacttggagagcgactatttcggcaagctggagtccaagttgagcgttattaggaacctgaatgatcaggtcctgtttatcgatcaggggaacaggccactgtttgaggatatgaccgattccgattgtagagacaacgccccccggacaatctttattatctcaatgtacaaagatagtcagcccaggggtatggctgtcactatctcagtaaaatgtgagaagattagtaccctgtcctgcgaaaacaagatcatatcctttaaggagatgaacccaccagataacatcaaggacactaagagcgacataattttctttcaaagatctgttcccggtcacgataataagatgcaattcgaaagtagctcttacgaggggtatttcttggcctgcgagaaggaaagggatctgtttaaactgatactgaagaaagaggatgagcttggcgacagatctatcatgttcactgtgcagaacgaggac

SEQ ID NO: 33297 - DNA, 579 bp, Artificial Sequence
  Description of Artificial Sequence: Synthetic coding sequence
atggcagcggaaccagtggaggataattgtatcaactttgtcgccatgaagtttatagataacactctgtacttcattgcagaggatgatgagaacctggagtcggactattttggaaagttggagagcaagctctcggtaatacggaatctcaacgatcaggtgttgttcatagaccaaggtaaccgcccactgtttgaggacatgaccgattccgactgtagagataacgcaccccgtactatcttcatcatcagcatgtacaaagactcgcagcctagaggaatggccgtgaccatttcagtgaagtgcgaaaagattagtacgctgtcgtgtgagaacaagattatctcatttaaggaaatgaatccccctgacaatatcaaagataccaagtctgacatcatcttctttcagagatcggtgcccggtcatgacaacaaaatgcaattcgaatcgtcctcctacgaaggctactttctggcatgcgaaaaagaacgggatctgtttaagctcatattgaaaaaggaagatgaacttggggaccgatcaattatgttcaccgtgcaaaatgaggac

SEQ ID NO: 33298 - DNA, 579 bp, Artificial Sequence
  Description of Artificial Sequence: Synthetic coding sequence
atggccgctgagcctgtggaagataactgtatcaactttgtggccatgaaattcattgataacacgctttactttatagcagaggacgatgagaatcttgaatcagattacttcggcaaactcgagtcgaaactttcagtcataagaaacctgaacgatcaagtgctgttcatcgaccagggtaacagacctctctttgaggacatgactgattcggactgccgcgataatgctccacgtacgatctttatcatttctatgtacaaggatagccaacccagaggtatggcggtcactattagcgtcaagtgtgagaaaatctcaaccctgtcctgtgagaataagatcatttcctttaaggagatgaatccgcccgataacattaaagatactaagtcagatatcattttctttcagcggagcgtcccagggcatgacaataagatgcaattcgaatcgagtagctacgaagggtatttccttgcatgtgaaaaggaacgagatctctttaaacttattctgaaaaaggaagatgaactgggagatcgttcgattatgttcactgtgcagaacgaggat

SEQ ID NO: 33299 - DNA, 579 bp, Artificial Sequence
  Description of Artificial Sequence: Synthetic coding sequence
atggccgcagagccggtcgaagacaattgcatcaactttgtcgcaatgaagttcattgataataccttatacttcatcgccgaggatgatgagaatctggagagcgattattttggtaaactcgagagcaaactatctgtcatccgcaacctaaacgaccaggtgctgtttattgaccagggcaatagacctttgtttgaggacatgacggattcagattgcagagataacgctccaagaacgatctttatcatctctatgtataaggatagtcagccccgcggtatggctgtaaccattagtgtgaagtgcgaaaaaatttcgacattatcttgcgagaataagatcatctcctttaaggagatgaacccacccgacaatattaaagatacaaaatctgacatcatcttttttcaaaggtctgtgccgggacacgataacaagatgcagtttgagtcttcctcttatgaaggttactttctggcatgtgaaaaggagcgggatctgttcaaactcatcctgaagaaggaggatgaattgggagatagatcaatcatgttcacagttcagaacgaggac

SEQ ID NO: 33300 - DNA, 579 bp, Artificial Sequence
  Description of Artificial Sequence: Synthetic coding sequence
atggccgctgagccagttgaagataactgcatcaacttcgtggcaatgaaatttatcgacaacaccctgtacttcatcgctgaggacgatgaaaatctggagagcgattactttgggaagttagaatccaaactctcagtcattagaaatttgaacgaccaagttctgttcatcgatcagggaaaccgccccctctttgaagatatgacagattcagattgccgtgataacgcccccagaactatcttcatcatatcaatgtataaggactcccagcctcgcggcatggccgttacaatatcagtgaagtgcgaaaaaataagcactctctcctgtgaaaataaaattatatcatttaaagagatgaacccaccggataatatcaaggatacaaagtcagacatcatctttttccagaggtccgttccaggacacgacaacaaaatgcagtttgagtccagctcctatgaggggtacttcctggcatgcgaaaaggagcgcgacttatttaagctgattctcaagaaagaagatgaactgggtgatcgcagcatcatgtttaccgtccaaaacgaagac

SEQ ID NO: 33301 - DNA, 579 bp, Artificial Sequence
  Description of Artificial Sequence: Synthetic coding sequence
atggctgcggagccagtggaagacaattgcattaacttcgtcgctatgaagttcatagataacactttatacttcatcgctgaagatgatgaaaatctcgaatcggattacttcggtaaattggagtccaaattatctgttatccgcaacttgaatgatcaagtactgtttattgatcaagggaaccgaccacttttcgaggatatgacggacagtgattgccgtgataatgccccacgaacaattttcatcatttcaatgtacaaagattcacagccaagaggcatggcagtcacaatttcagtcaaatgtgaaaaaatatcaacgttatcgtgtgagaacaagattatttcgttcaaagagatgaatccaccagataatattaaagatacaaaaagtgatattatctttttccaaagatccgtacctggacacgacaacaaaatgcagtttgaatcatcatcctatgaggggtacttccttgcttgcgaaaaggaaagagatctgttcaagctcatactcaagaaggaagacgagcttggagatcgttcaatcatgtttacagtccaaaatgaagat

SEQ ID NO: 33302 - DNA, 579 bp, Artificial Sequence
  Description of Artificial Sequence: Synthetic coding sequence
atggccgctgagcctgtagaagacaactgcatcaacttcgtggctatgaagttcattgacaatacactgtacttcatcgccgaggacgacgaaaatctagagagcgattatttcgggaaattggaaagtaagctctcagtcatcaggaatctgaacgaccaggttctcttcatcgatcagggtaatagaccactatttgaagatatgacagactcggattgtagggataacgcgccacgcacaatattcatcattagcatgtacaaagattcacagccaagaggcatggctgtaactattagcgtgaagtgtgaaaagatctccacattgtcctgtgaaaacaaaatcatctcctttaaggagatgaacccccccgataatataaaagacacaaagagcgatatcattttttttcagcggagtgtccccgggcacgacaacaagatgcagtttgagtcgtcttcttacgaagggtattttcttgcttgtgaaaaggagagggacctattcaagttgatccttaagaaggaggacgagttaggcgaccgctcaataatgtttacagtccaaaatgaggat

SEQ ID NO: 33303 - DNA, 579 bp, Artificial Sequence
  Description of Artificial Sequence: Synthetic coding sequence
atggccgccgagccggtggaggacaactgcatcaacttcgtggctatgaaattcatcgataacaccctgtacttcatcgcagaagatgacgagaacctggaatccgactacttcggcaagctggaatcaaagctgtccgtgatccgcaatttgaatgaccaggtgctgtttatcgaccaaggtaatcgccctctctttgaggatatgaccgattcggactgcagagacaatgcccctcgcaccattttcatcatttccatgtacaaggactcgcagccgagaggcatggccgtgaccatctccgtgaagtgcgaaaagatctcgaccctgtcttgtgaaaacaagattatctctttcaaagaaatgaatcccccggataacatcaaggatactaaatcggacatcattttcttccagcgctcagtgccaggccatgacaacaaaatgcagttcgagagcagctcctacgagggatacttcctggcttgcgagaaggaacgcgatctgttcaaactgatcctcaagaaagaggatgaactgggagatcggtccattatgttcacggtccagaacgaagat

SEQ ID NO: 33304 - DNA, 579 bp, Artificial Sequence
  Description of Artificial Sequence: Synthetic coding sequence
atggccgccgagccagtggaggataactgcattaacttcgtggccatgaaatttattgacaataccctgtactttattgcagaggatgatgagaacctggagagcgattattttggaaagctagaatccaagctgtcagtgatccgaaacctcaacgaccaggtgctgttcatcgaccaagggaaccggccgttgtttgaggacatgacagatagtgactgtagggacaatgcacccaggactattttcattattagcatgtataaagattctcagcctcggggcatggccgtgacaatctccgtcaagtgtgagaagatttctaccctgagttgtgagaacaaaataatcagttttaaggagatgaaccctccagacaacattaaagacaccaaatctgatatcatctttttccaacgctctgtcccaggtcacgataataaaatgcagtttgagtcatcaagctacgaaggatactttctggcttgtgagaaggaacgggatctgtttaaactcatcctaaagaaagaggatgaactaggtgatcgcagcattatgtttacagttcaaaacgaggat

SEQ ID NO: 33305 - DNA, 579 bp, Artificial Sequence
  Description of Artificial Sequence: Synthetic coding sequence
atggctgcagagcctgtggaggataattgcattaatttcgttgcaatgaaattcattgacaataccctgtacttcatcgcagaagacgatgaaaacttggaatcggattactttggaaagttagagtcaaaattgtccgtgatccgaaacctgaacgatcaggtcttatttattgatcaagggaaccggcctctgttcgaggacatgaccgacagcgactgtcgcgacaacgctccgaggacaatctttataatctcaatgtataaggacagtcagccgcggggaatggcagtcaccatttccgtgaaatgcgagaagatttcgactctatcatgcgagaacaagataataagcttcaaggagatgaatcccccagataatataaaggacactaaatctgacatcattttttttcagaggtccgttccgggacacgacaacaaaatgcaatttgaatcaagctcctatgaaggctacttcctggcatgcgagaaggagagagatctgttcaagttgattctcaagaaggaagacgagttgggagatcgttccataatgttcaccgtgcagaacgaagat

SEQ ID NO: 33306 - DNA, 579 bp, Artificial Sequence
  Description of Artificial Sequence: Synthetic coding sequence
atggccgccgagccagtggaagataactgcattaactttgtagcaatgaagtttattgacaacacgctgtacttcattgcggaggacgatgaaaacctggaaagcgattactttggcaagttggagtccaagctgtcagtgatcaggaatctcaacgatcaagtacttttcatcgaccaaggaaacagaccactgttcgaggatatgaccgattccgactgtcgggacaacgcccctaggacaatcttcataatttccatgtataaggactctcagccccgggggatggccgtcaccatctctgtgaagtgtgagaaaatttccacgctctcttgtgaaaataaaataatctcgttcaaggagatgaacccacccgacaacatcaaagacactaagagcgatattattttttttcaacgaagcgtgccaggccacgataataaaatgcagtttgaatcaagctcctatgaagggtactttttagcttgtgaaaaagaacgggacctgttcaagctcatcttgaagaaggaggacgaactgggggatagaagtattatgtttactgtgcagaatgaggac

SEQ ID NO: 33307 - DNA, 579 bp, Artificial Sequence
  Description of Artificial Sequence: Synthetic coding sequence
atggccgccgagccagtggaggacaactgcattaacttcgtggcgatgaaattcatcgacaacactctttacttcatcgccgaggacgatgaaaatctggaaagcgactacttcggcaaacttgaaagcaagctgtccgtcattcggaatctgaatgaccaggtgctgttcatagatcaaggaaatagaccgttgttcgaagatatgaccgactcggattgccgcgataacgctcctcgtaccatctttatcatctctatgtacaaggactcccagccccgaggcatggctgtgactatctcggtcaagtgcgaaaagatcagcaccctctcatgcgaaaacaagattatcagctttaaggagatgaatccgccagataacatcaaagacactaaatctgatatcattttcttccaacgctcggtgccgggacacgacaataagatgcagttcgagtcctcgtcatacgagggttatttcctggcttgtgaaaaggagcgggacttgtttaaactgatcctcaagaaagaggatgaattgggagacaggtcgatcatgtttaccgtgcagaacgaggac

SEQ ID NO: 33308 - DNA, 579 bp, Artificial Sequence
  Description of Artificial Sequence: Synthetic coding sequence
atggcagcagaacctgttgaagataactgtataaacttcgttgcaatgaagtttatcgacaataccctctactttatagcggaagatgacgaaaatctcgaaagcgattactttggtaagctggagtctaaactgagcgtcatcagaaatttgaatgatcaagtgcttttcatagaccaaggtaatcggccccttttcgaggacatgacggattcggattgtcgagataacgcccctcgaaccattttcatcatttcgatgtacaaggattcccagcctaggggtatggctgtcactatcagcgtgaaatgcgagaagatttccaccttgtcgtgcgaaaacaagatcatatcgttcaaggagatgaacccaccagacaacattaaggacaccaagtcggacattatcttttttcagagaagcgtcccaggtcatgataacaaaatgcagttcgaatcatcgtcatacgagggatatttcctcgcctgtgagaaggaaagagatctgttcaaacttatactgaagaaggaagatgaacttggagatcgatccatcatgtttactgtccaaaacgaagat

SEQ ID NO: 33309 - DNA, 579 bp, Artificial Sequence
  Description of Artificial Sequence: Synthetic coding sequence
atggcggctgaacccgttgaggacaactgcatcaactttgtcgctatgaagttcatcgataacactctgtacttcatagcagaggacgatgagaatttggagtcggattacttcggcaaactagaatcgaagctatccgttatccgaaacctcaacgatcaggtgctgttcatcgaccagggcaacaggccactgttcgaggatatgacagacagcgactgccgcgacaacgcaccgcgtaccatcttcatcatctccatgtacaaggactctcagcctcgcggtatggcagttactatcagcgtgaagtgtgaaaaaatctctacgctttcttgcgagaacaagattatatccttcaaagagatgaacccgcccgacaacatcaaggatacaaagtccgatattatcttcttccagcgctcggtgcccggccatgataacaagatgcagttcgaatccagcagctatgagggctactttcttgcatgcgagaaggagcgagacctgttcaagctcatccttaagaaggaggatgagctcggtgaccgctcgatcatgttcaccgtccagaacgaagat

SEQ ID NO: 33310 - DNA, 579 bp, Artificial Sequence
  Description of Artificial Sequence: Synthetic coding sequence
atggcggccgagccggtggaggacaattgcatcaatttcgtggctatgaagttcatcgacaatactctgtactttatcgccgaagatgatgaaaacctggagtcagactatttcggaaagctggagagcaagttgagtgtgatccgcaatctcaacgaccaagtgctgtttatcgaccagggaaaccgcccgctgttcgaggacatgaccgattcagattgtagagataatgccccgcggacgatctttatcatttcaatgtacaaagactcgcaaccaagaggaatggctgtcaccatcagcgtgaagtgtgagaagatctccaccctgtcctgtgaaaacaagatcatttcattcaaggagatgaacccgccagacaacattaaagacactaagtccgacatcattttcttccagcgcagcgtgccggggcacgataacaagatgcagttcgaatcttcgtcctacgagggatacttcctcgcgtgcgagaaggagagggatcttttcaagctcatactgaagaaggaagatgaactcggcgaccggtcgattatgtttaccgtgcaaaatgaggac

SEQ ID NO: 33311 - DNA, 459 bp, Artificial Sequence
  Description of Artificial Sequence: Synthetic coding sequence
atgtatcggatgcagctgctctcatgcatagcactcagcctcgcgttggtgaccaatagtgcgcccacgtcttcaagcactaagaagacgcaactgcagcttgagcatctccttctcgatctgcaaatgatcttaaacggcattaacaactacaagaatccaaagttaacaaggatgcttacctttaaattctatatgcccaagaaagctacagagctaaaacacctgcaatgtctcgaagaagaactgaagcctcttgaggaagttctcaacctcgcccaatccaagaactttcatctccgtcctcgtgatttgatctcaaatattaacgtgatagttttggagctcaaggggagcgaaactacgttcatgtgcgaatatgcggacgaaaccgccacaatcgtagaattcctcaacagatggatcacattttgtcagagcattatctcaaccttaact

SEQ ID NO: 33312 - DNA, 459 bp, Artificial Sequence
  Description of Artificial Sequence: Synthetic coding sequence
atgtatcgaatgcaactattatcgtgtatagcgctatcgctagcgctagttacgaattcggcgccgacgtcgtcgtcgacgaaaaaaacgcaactacaattagaacatctattactagatctacaaatgatactaaatggtataaataattataaaaatccgaaattaacgcgaatgttaacgtttaaattttatatgccgaaaaaagcgacggaactaaaacatttacaatgtttagaagaagaattaaaaccgttagaagaagtactaaatctagcgcaatcgaaaaattttcatctacgaccgcgagatctaatatcgaatataaatgttatagtattagaattaaaaggttcggaaacgacgtttatgtgtgaatatgcggatgaaacggcgacgatagtagaatttttaaatcgatggataacgttttgtcaatcgataatatcgacgttaacg

SEQ ID NO: 33313 - DNA, 459 bp, Artificial Sequence
  Description of Artificial Sequence: Synthetic coding sequence
atgtaccggatgcagcttctttcctgtattgcactttctctggcgcttgtgactaactccgcaccaacgagctcgagcactaaaaagacgcagttgcaattggaacacttgctgcttgatcttcaaatgattcttaatggaatcaacaactacaagaatcctaagttgacccggatgttgacctttaagttttacatgccgaagaaggcaaccgaactcaagcatcttcaatgtcttgaagaagagctgaaaccactggaagaagtgctgaacctggcacagtcgaagaactttcaccttaggccaagagatctgatctccaacattaacgtgattgtgctggagctgaaagggtcagaaaccacttttatgtgcgaatacgccgacgaaactgccaccattgtggaatttcttaatcggtggattactttctgtcaatcgatcatttccaccctgacc

SEQ ID NO: 33314 - DNA, 459 bp, Artificial Sequence
  Description of Artificial Sequence: Synthetic coding sequence
atgtaccggatgcagctgctcagctgtattgccctctcgcttgccctcgtgactaactcagcacctacctcctcatcgactaagaaaactcagcttcagcttgagcacctgcttctcgatctgcaaatgattctgaatggtattaacaactacaagaatccaaagctgacccgcatgctgacctttaagttctacatgccaaaaaaggcgactgaactcaagcacttgcaatgtctcgaagaagagctcaagccgctggaagaagtgcttaatcttgcacagtcgaagaacttccatctgcgtcctagagatcttatctcaaacatcaatgttatagtgcttgaacttaagggttcggaaactacgtttatgtgcgagtacgccgatgaaaccgcaactattgtggagtttctgaacagatggattaccttttgccaatcaatcatttcaactttgacc

SEQ ID NO: 33315 - DNA, 459 bp, Artificial Sequence
  Description of Artificial Sequence: Synthetic coding sequence
atgtacagaatgcagctccttagttgtattgctctttcactggcactggtgactaattctgcccctacctccagctctaccaaaaagactcagctgcagctggagcacctcctgcttgatcttcagatgatcctgaatgggattaataactacaagaacccaaagttgacaaggatgctgaccttcaagttctacatgcctaagaaagctacagagcttaagcacttgcagtgcctggaggaggagctgaagcctctggaagaagtgctcaatttggcccaatctaagaactttcacctgagaccccgcgatctaatctcgaacattaacgtgattgtgttggaactcaagggcagcgaaacaacttttatgtgtgagtatgctgacgagaccgctactatcgtcgaattcctgaaccggtggattactttttgccaaagtatcatttccaccttgacc

SEQ ID NO: 33316 - DNA, 459 bp, Artificial Sequence
  Description of Artificial Sequence: Synthetic coding sequence
atgtaccgaatgcaactgctgtcgtgcatcgccctttctctcgccctggtgaccaactcagcgcctacttcgtcctcaaccaagaagactcagctgcaactggaacatttgctcctcgacctccaaatgatcttgaatggtatcaataactataagaacccaaagctcacccggatgctcacttttaagttttacatgccgaagaaagccactgagcttaaacatctgcaatgccttgaagaagagttgaagccgttggaggaagtgttgaatctggcacagagcaagaacttccatcttaggcctcgggatctgataagcaacatcaacgtgatcgtcctggagctgaagggaagcgaaacgaccttcatgtgtgagtatgccgacgagacggctactatcgtggaattcctgaaccgctggatcaccttctgccagtcgatcatttcgactctgacg

SEQ ID NO: 33317 - DNA, 459 bp, Artificial Sequence
  Description of Artificial Sequence: Synthetic coding sequence
atgtaccggatgcaattgctttcttgcatcgctctcagcctcgcgctggtcactaactccgctcccacctcttccagtacgaaaaagacacagttgcagctggagcacctcctccttgatctccaaatgatcctgaatggtattaataactataaaaaccctaaactgacgagaatgttaacctttaagttttatatgcccaagaaggcaactgaactcaagcatcttcagtgtctggaggaagagctcaagcctctcgaagaggtcttaaatcttgcccaatctaagaactttcatctcagaccgagagacctgatttctaatatcaatgttatagtgttagagctcaagggcagtgagaccacattcatgtgcgaatatgctgacgagacggccaccatcgtcgagttcctgaacaggtggattactttttgtcaatcaattataagcaccctgacc

SEQ ID NO: 33318 - DNA, 459 bp, Artificial Sequence
  Description of Artificial Sequence: Synthetic coding sequence
atgtacagaatgcagctgctgtcgtgcatcgctctctcgctggccctggtgactaactccgcgcctacctcgtctagcaccaagaaaactcaactccagctggaacatttgctgctggatctccagatgatcctcaacggaattaacaactacaagaacccaaagctgaccaggatgctgactttcaagttctatatgccgaagaaagcgaccgaacttaaacatcttcaatgcctcgaagaggaactgaaaccactggaagaagtgctgaatttggcgcagtcgaagaacttccatttgcgcccgagagatctcatctcaaatatcaacgtgatcgtcctggagctgaaaggctccgaaaccactttcatgtgcgaatacgcagacgagactgctaccatcgtcgagtttctgaaccggtggattactttctgccagtcgatcatctcaacgctgacc

SEQ ID NO: 33319 - DNA, 459 bp, Artificial Sequence
  Description of Artificial Sequence: Synthetic coding sequence
atgtacagaatgcagttgctttcctgcattgctctcagcctcgccctagtcaccaactctgcaccgacctccagttctaccaagaagactcagctccagctggagcatcttttgctcgatcttcagatgattctaaacggtatcaataactataaaaaccccaagctaacccgtatgctcaccttcaaattttatatgcccaagaaggctaccgagctaaagcaccttcagtgcctggaggaggagcttaagcctctcgaggaagtgctaaaccttgctcagtcaaagaacttccatctcaggccaagggatctaatcagcaacatcaacgtcatcgtcctagagctgaagggcagcgagacgacctttatgtgcgagtacgccgacgagacggccacgattgttgaattcctgaaccggtggatcaccttctgccaatcgattataagcaccctgacc

SEQ ID NO: 33320 - DNA, 459 bp, Artificial Sequence
  Description of Artificial Sequence: Synthetic coding sequence
atgtaccgcatgcaactcctgagttgtattgctttgtctctggcactggttacaaactcagcaccaaccagtagcagtactaagaaaacacaactccagctggagcaccttcttctagatttgcaaatgatcctcaacggaatcaataattataagaacccaaaactgaccagaatgctgacttttaagttctatatgcccaagaaggctacagaactgaagcacctgcaatgcttggaagaggagctcaagcctctagaagaagtgctcaatctagcgcaatcaaaaaacttccacctgagaccgcgcgatctgatctccaatatcaacgttatcgttctggaacttaaggggagcgagaccacattcatgtgcgaatacgctgatgagactgctacaatcgtcgaattcctgaacagatggatcaccttttgccaatcgataatctcaactcttacc

SEQ ID NO: 33321 - DNA, 459 bp, Artificial Sequence
  Description of Artificial Sequence: Synthetic coding sequence
atgtaccggatgcagctcctgtcctgcatcgccctttctctggccctcgtgaccaattcggccccaacgagttccagcactaaaaagactcaactgcaacttgaacaccttttgctcgatctccagatgatcctgaacggaatcaacaactacaagaacccgaagctcactagaatgctgacctttaagttttacatgcctaagaaggcgactgaactgaaacatctgcaatgcctcgaggaggagctgaagccactggaagaagtgctgaatctggctcagtcgaaaaacttccacttgcgcccgcgcgacctgatctccaacatcaatgtgattgtactggagttgaagggctcagaaaccactttcatgtgcgaatacgcagacgaaacggcgaccatcgtcgagttcctgaaccggtggatcactttctgtcagtcaatcatttctaccctcacg

SEQ ID NO: 33322 - DNA, 459 bp, Artificial Sequence
  Description of Artificial Sequence: Synthetic coding sequence
atgtacaggatgcagttactttcttgcattgcccttagtctcgctctcgtgacaaactcagcgcctacctccagtagcaccaagaaaactcagctccaactggaacatctgctgctggatctgcagatgatactgaatggcataaataactacaaaaaccccaaacttacacggatgttgacatttaaattctatatgcccaagaaagctactgagcttaaacatttgcagtgtcttgaagaggagctgaagccccttgaagaggtgttgaacttagcacagtctaaaaactttcacctgcgcccccgtgacctgatatcaaatataaacgtgatcgtgctggagctgaagggctccgagacgacctttatgtgtgagtacgcagatgagacagcgaccatcgtcgaattcttaaaccgctggataaccttttgtcaatctataatctccacactcacc

SEQ ID NO: 33323 - DNA, 459 bp, Artificial Sequence
  Description of Artificial Sequence: Synthetic coding sequence
atgtatcgcatgcagctgctgagttgtatcgcgctatcactggccctggtcaccaattcagcccccaccagtagttctaccaagaagacccaacttcagttggagcacctactgctggacttacaaatgatcctgaacggaataaataattacaaaaatcccaaactaacgcgcatgctcacatttaagttttatatgcccaaaaaagctactgaattgaagcatttgcagtgtcttgaggaggaactaaagccgctggaggaggtgttgaacctggcacagtctaagaactttcacctgcggcccagggacctgatctcaaatataaacgtgattgtgctcgagctgaaggggtcggaaacgacgtttatgtgcgagtatgcggacgagaccgcaactatcgtggagttcctgaacaggtggatcactttctgccagagtatcatttctaccttaacc

SEQ ID NO: 33324 - DNA, 459 bp, Artificial Sequence
  Description of Artificial Sequence: Synthetic coding sequence
atgtacaggatgcaactgctgtcctgcattgcgttgtctcttgcactcgtcactaactccgcaccaacgagctcgtccaccaaaaagactcagcttcaacttgaacacctcctgctggatcttcagatgattctgaacggtattaacaactacaaaaacccaaaacttactagaatgctgacgtttaagttttacatgcctaaaaaggcaaccgaattgaagcatctgcaatgtttggaagaagagctgaagcctcttgaggaagtgctcaaccttgctcaaagcaagaattttcacctcaggccccgggacctgatatcgaacattaatgtcatcgtgctcgaacttaaggggtcggaaaccaccttcatgtgtgagtacgccgatgagactgcaaccatcgtcgaatttcttaatcggtggatcactttttgtcaatccattatctcgactctgacc

SEQ ID NO: 33325 - DNA, 459 bp, Artificial Sequence
  Description of Artificial Sequence: Synthetic coding sequence
atgtataggatgcagctgctgtcttgcatagccctgtcactagccctagtcaccaacagcgcaccaaccagctcaagcacaaaaaagacccagcttcagttggagcatctcctgctcgatcttcagatgattttaaacggcatcaataattataagaaccctaaactcacccgaatgctgaccttcaaattttatatgccaaagaaggccaccgaactcaagcatctgcaatgtcttgaagaggagctcaagcctttggaggaagtcctgaatcttgcacagtccaagaacttccatctgagaccccgcgacctgatctcaaatatcaatgtaatcgtcttagaactaaagggatcggagaccacattcatgtgcgagtacgccgacgaaaccgcaaccatcgtggaatttctgaacagatggatcactttctgccagagcataatttctaccctgacc

SEQ ID NO: 33326 - DNA, 459 bp, Artificial Sequence
  Description of Artificial Sequence: Synthetic coding sequence
atgtacaggatgcagctactgtcctgtatcgctctgtctctggcactcgtaaccaactctgctccgaccagttcctcaacgaagaagacgcagttgcagttggaacacctcctgctggacctgcaaatgattctcaatggtattaataactataaaaatccaaaactcactagaatgctgacattcaaattctatatgccgaagaaggcaacagagctgaaacaccttcagtgcctcgaggaggagctgaagcctctagaggaggtgctaaacctggcccagtcaaagaatttccacctgaggccccgcgatttaatcagtaatatcaatgtcattgtcctggagcttaagggatctgaaacaaccttcatgtgtgagtacgcagacgagacagctaccatcgtggaattccttaaccggtggattacgttttgccagtcaatcatatccactctaacc

SEQ ID NO: 33327 - DNA, 459 bp, Artificial Sequence
  Description of Artificial Sequence: Synthetic coding sequence
atgtaccgcatgcagctgctctcatgcattgctctgtcgctggcgcttgtcactaatagcgcaccaacctcctcctccaccaaaaagacccaacttcagctggaacatcttctgcttgacctccagatgatactcaatggtatcaataactacaaaaaccccaaacttacccgaatgttgacctttaagttttacatgcctaagaaagcgactgagcttaagcatttgcaatgccttgaagaagaactcaagccactggaagaggtgctgaacctggcgcaatcaaagaactttcatctccgcccgcgtgaccttatttccaacatcaatgtgattgtccttgaactgaaaggatcggaaaccacctttatgtgtgaatacgctgatgagactgcaacgattgtggagtttcttaatcggtggataactttttgtcagtcgattatctccactctgacc

SEQ ID NO: 33328 - DNA, 459 bp, Artificial Sequence
  Description of Artificial Sequence: Synthetic coding sequence
atgtatcggatgcagcttcttagctgcatcgcactgtcattggccttggtcaccaattcagcgccgacctcctcttcgactaagaaaacgcagcttcagctggaacaccttctgctggacttgcagatgattttgaacggaatcaataactacaagaacccgaaactcacgagaatgctcaccttcaaattctacatgcccaagaaggcgaccgagctcaagcacctgcaatgtttggaggaggaactgaaaccattggaagaagtgctcaaccttgctcaatccaagaattttcatctgcggcctcgagatttgatatcgaacataaacgtgattgtgctggaactgaagggctcggagacgactttcatgtgcgagtacgccgacgagactgccaccatcgtcgaatttcttaatcgctggatcaccttctgccagagcatcatctcaaccctgacc

SEQ ID NO: 33329 - DNA, 459 bp, Artificial Sequence
  Description of Artificial Sequence: Synthetic coding sequence
atgtatagaatgcagctgctgtcctgcattgctctttccctggctcttgttactaactcagcacccacctctagcagtactaagaaaacacagctgcagttggaacacctgctgctcgacctccagatgatcctcaacggaatcaataattataaaaatcccaaactgaccaggatgctcacattcaagttttacatgccaaagaaagcgacagaactgaagcacctgcagtgtctggaggaggaactgaagcctctggaggaggtcctcaatctggcgcagtctaagaattttcacctgaggcctcgggatctcatctctaacataaatgtcatcgtgttggagctgaaaggtagcgagactaccttcatgtgtgaatatgctgatgaaaccgccacaatcgtcgaattcctgaatcgctggattactttttgccagtctattattagcactttgacc

SEQ ID NO: 33330 - DNA, 459 bp, Artificial Sequence
  Description of Artificial Sequence: Synthetic coding sequence
atgtacagaatgcaattgctctcttgtatagcactttccctcgcactcgtcaccaattccgcccctacttcatcgtccaccaagaaaactcaacttcagctcgaacatcttcttctcgacctgcagatgatccttaacggcattaacaattacaagaatcccaaattgactagaatgttgacttttaagttctatatgcctaagaaggccaccgaacttaagcatcttcagtgtctggaagaagaactcaaaccgctggaagaagtgctcaatcttgcccagagcaaaaacttccatctgcgtcctcgggatttgatttccaacattaatgtgatcgtgcttgaacttaaggggtcagaaaccacctttatgtgcgaatacgctgatgaaactgcaaccattgtcgagtttcttaaccggtggataacgttttgccaatccatcattagcaccctgact

SEQ ID NO: 33331 - DNA, 459 bp, Artificial Sequence
  Description of Artificial Sequence: Synthetic coding sequence
atgtacagaatgcaacttctgtcgtgtattgcattgtcgctggccctggtgactaacagcgccccaacctcaagctctaccaaaaagacccaacttcaactggagcacctcttgcttgacctccagatgatactcaacggtattaacaattacaagaacccaaaacttactaggatgcttactttcaaattctacatgcctaagaaggcgaccgaactcaagcatcttcagtgccttgaggaggaattgaagcctctggaggaggtgctgaatctcgcccagtcgaagaactttcatcttagaccgagggatttgatttccaacattaacgtgatcgtgcttgaactcaagggaagcgaaactacttttatgtgcgaatacgctgatgaaaccgcaactattgtggaattccttaaccgttggattactttctgtcaaagcattatctctacccttacc

SEQ ID NO: 33332 - DNA, 459 bp, Artificial Sequence
  Description of Artificial Sequence: Synthetic coding sequence
atgtaccggatgcagctcctctcatgcatcgcgttgagcctcgcgctcgttaccaactccgccccaacctcttcatcgaccaaaaagactcagctgcaacttgagcatctgctgctggatctccagatgatcttgaacggcatcaataactacaagaatccgaaattgactaggatgctgacctttaagttttacatgcccaagaaagcgactgagctgaagcacctccagtgccttgaggaagaacttaagcctctggaagaagtgctgaatctggcccagtcaaagaatttccatctccgcccgcgcgacctgatctcgaatatcaatgtcatcgtgttggaactgaagggttccgagactaccttcatgtgcgagtatgctgacgagactgccacgattgtggaattcctgaatcggtggataacgttctgtcaatccatcattagcactctgacc

SEQ ID NO: 33333 - DNA, 459 bp, Artificial Sequence
  Description of Artificial Sequence: Synthetic coding sequence
atgtataggatgcagctgctgagctgtatcgccctgagccttgcacttgtgaccaactcagcacctacttcatcaagtactaagaagacacagttgcagcttgagcacctgctccttgatctccagatgatcttgaacggtattaataactacaaaaatcctaaactcactcggatgttgacatttaagttctatatgcccaaaaaggcaacggaactcaaacacctccagtgtttggaggaggaactgaagccacttgaggaagtgcttaacttggcgcagagcaaaaactttcatctgcggcctcgggatctcatatccaacataaacgtgatcgttctcgagctgaaaggttccgaaactacatttatgtgtgaatacgctgacgagacagctaccatcgtcgagtttttgaaccgatggataactttttgtcagagcatcatttctacactgacc

SEQ ID NO: 33334 - DNA, 459 bp, Artificial Sequence
  Description of Artificial Sequence: Synthetic coding sequence
atgtacaggatgcagctgttgtcatgtatagcactaagcctcgctctcgtgacaaactccgcccctacctcctccagcaccaagaaaacccagctgcagctggaacacctgctgttggatctacagatgattctcaatggaatcaacaattacaagaaccctaaactgactagaatgctgactttcaaattttacatgccaaagaaagcgacagagttgaagcacctccagtgccttgaggaagagttgaaaccactcgaggaggtgctgaacctggcccagtctaaaaactttcacctgcggcccagagacctgatatctaatattaatgttatagtgctggagttgaaaggctcggagactacgtttatgtgtgaatatgccgacgagacggccaccatagtcgaatttttaaatcgctggattaccttttgtcagtccatcatctccactctgacc

SEQ ID NO: 33335 - DNA, 459 bp, Artificial Sequence
  Description of Artificial Sequence: Synthetic coding sequence
atgtacagaatgcaactgttgtcctgtattgccctctcgctggcacttgtcactaacagcgcccccacttctagctcgaccaaaaagacccagctccagcttgagcacctgttgcttgatctccagatgatcctgaatgggatcaataactacaagaacccaaaactcactcgaatgctcacctttaagttttacatgcctaagaaggcaaccgaacttaaacatctgcaatgcttggaagaggaactgaagcctttggaagaagtgcttaacctggctcaatccaagaattttcatttgaggccgcgcgacttgatcagtaacataaacgtcattgtgcttgaactgaagggttcggagactaccttcatgtgtgaatacgcagatgagactgcgacgattgtggaattcctgaatcggtggattacgttttgtcaatccatcattagtactcttacc

SEQ ID NO: 33336 - DNA, 459 bp, Artificial Sequence
  Description of Artificial Sequence: Synthetic coding sequence
atgtacagaatgcaactgctgagttgtatcgctctcagcctggccctcgtgacaaactccgccccgacaagctcctctactaaaaaaacccaactgcagctcgaacacctgctactggaccttcagatgatccttaatggcatcaacaactacaagaatcccaaactgacgcgtatgctgacatttaaattttatatgcccaagaaggcaaccgagctcaagcatctacaatgtttggaggaggagctgaagcctctggaggaagtgctcaacctggctcagtctaaaaatttccacttacgccccagggacttgataagcaacatcaatgtgatcgtgctggaactgaagggatcggagaccacatttatgtgtgagtatgcggacgaaaccgctaccatagtggagttcctgaacagatggataacgttctgtcagtcaatcatttccacccttacc

SEQ ID NO: 33337 - DNA, 459 bp, Artificial Sequence
  Description of Artificial Sequence: Synthetic coding sequence
atgtacagaatgcagctcctgtcctgtattgcactgtcgttggcactcgtcaccaattcggcacctacttcaagctcaaccaaaaagactcagcttcagttggaacacctgcttctcgatcttcagatgatcctgaacggtatcaacaactataagaaccctaaacttactcgcatgctgacctttaagttctacatgccaaagaaagcaacggaactcaaacatcttcaatgtctggaggaagagctgaagccacttgaagaggtgctgaacctcgcgcagtctaaaaacttccatctccggcctcgtgatctgataagcaacataaacgtgattgtccttgaactcaagggatcggaaaccacgtttatgtgtgaatacgcagacgagactgccaccattgtggaattcctgaaccgctggattaccttttgccaatcaattatctcgactcttact

SEQ ID NO: 33338 - DNA, 459 bp, Artificial Sequence
  Description of Artificial Sequence: Synthetic coding sequence
atgtataggatgcagctgttgagctgtatcgccctgtcgctggcgctggtcacgaactccgcgcctacttcgtcatcgaccaaaaagacccagcttcaactcgagcacctcctgctggatttgcagatgattttgaacggaatcaacaattacaagaatccaaagctgactcggatgctgacctttaagttctacatgcccaagaaggcaacggagctgaagcatctccagtgcctggaagaagaactgaagcctcttgaggaggtgctgaacctcgcacaaagcaagaatttccatctgcgcccgcgagatctcatctcaaacatcaacgtgatcgtgctggaactgaagggttcggaaaccactttcatgtgtgagtacgccgacgaaaccgcaaccatcgtggaattcctgaaccggtggatcactttctgccagagcatcatctcgactcttact

SEQ ID NO: 33339 - DNA, 459 bp, Artificial Sequence
  Description of Artificial Sequence: Synthetic coding sequence
atgtaccggatgcagcttttatcctgcatcgccttgtccctggcgttggtgactaactctgccccaaccagtagtagtacaaagaagacccagctgcagctggagcacctcctgttagacctgcaaatgatattaaatggtatcaataactacaagaaccccaagctgacccgtatgctgactttcaagttctacatgcccaaaaaggccactgaactgaaacacctgcagtgtctagaggaagaactaaagcctctggaagaagtattaaatctggcccagtctaagaactttcatttgagaccacgagatctcatctctaacataaatgtgatagtgctggaacttaaagggtctgaaaccactttcatgtgcgaatatgctgacgaaacagctacaattgtcgaatttctgaatcgttggattactttctgtcaaagtatcattagcaccttaact

SEQ ID NO: 33340 - DNA, 459 bp, Artificial Sequence
  Description of Artificial Sequence: Synthetic coding sequence
atgtaccgtatgcaactattgtcatgcattgccctttcgctcgctctggttacaaattccgcgccaaccagctcctccaccaaaaagacccagctgcaattggaacaccttctgctggaccttcagatgatcctgaacggtattaataactataagaaccctaagcttacccggatgttgactttcaagttctatatgccgaagaaggccactgaattgaagcatctccagtgcctcgaagaggagctgaaaccgctggaagaggtacttaatttagctcagtcgaagaactttcatctgcgcccccgagacttgatcagtaacatcaatgttatcgtactcgagttgaagggttctgagacaactttcatgtgcgagtacgcggatgagaccgcaacaattgttgagtttctgaacagatggattaccttttgtcagtctattatctccacattgaca

SEQ ID NO: 33341 - DNA, 459 bp, Artificial Sequence
  Description of Artificial Sequence: Synthetic coding sequence
atgtaccgtatgcagttgctgtcgtgtatcgcactgtcgttggcgctggtgactaacagcgctccaacttcttccagtacgaaaaagactcagctccaactcgagcacctcctgctcgatctccagatgatcctgaacggcattaacaactacaagaatcccaagctgactcggatgctgactttcaaattctacatgccgaagaaagcgaccgagctgaaacacctccagtgcctggaggaagaactgaagccgctggaagaggtgcttaatctcgctcaatccaagaattttcacctccggcctcgggaccttatcagcaatatcaacgtgatcgtcttggaactcaagggctccgaaaccaccttcatgtgcgagtatgcagacgaaactgccactatcgttgagttcctgaatcgctggattaccttctgtcagtcaatcatctccacgctgacc

SEQ ID NO: 33342 - DNA, 459 bp, Artificial Sequence
  Description of Artificial Sequence: Synthetic coding sequence
atgtatcgcatgcagctgctctcttgcatcgccttatcactggcattggtgacaaatagcgccccgacatcaagctccaccaagaagactcaacttcagctcgagcatctcctgctggatcttcagatgatccttaacggaattaataattacaagaatcccaagctaactaggatgctgacattcaaattctatatgccaaagaaagctacagaactgaaacacctccagtgcctggaagaagagctgaaaccactggaggaggtgctcaacctcgcacagtcgaagaactttcatctgcggccccgcgacctcatctcgaatatcaatgtgattgtactcgagttgaaagggagcgagactacttttatgtgcgaatacgccgatgaaacagcaaccatagttgagttccttaacagatggattaccttctgccagagcatcatatctacccttacc

SEQ ID NO: 33343 - DNA, 459 bp, Artificial Sequence
  Description of Artificial Sequence: Synthetic coding sequence
atgtacaggatgcagctgttgtcctgcattgcactgagcctggcactggtgacgaactctgcaccgacttcatcctcaacgaaaaagacgcagctacagttagagcacctcctcctggacctgcaaatgatactaaacggtattaacaactacaagaatccgaagctgacacgaatgctgacttttaagttctatatgcccaagaaggccaccgagctaaagcatctgcaatgcctggaggaggaattaaagcccctcgaggaggtgttaaacctcgctcagagcaagaacttccacctcagaccaagggatctgatttccaatataaacgttatagttctggaactcaagggcagtgaaaccaccttcatgtgcgaatatgcagatgagactgccactattgtagaattcctgaatcgttggatcaccttttgccaatcgattatcagcaccctgacg

SEQ ID NO: 33344 - DNA, 459 bp, Artificial Sequence
  Description of Artificial Sequence: Synthetic coding sequence
atgtacaggatgcagctcctgtcctgcatcgcgctctccctggcactcgtgaccaactcggccccaacttcgtcatcgaccaagaaaacccagcttcaactggaacacctgctcttggacctccaaatgatcctgaacggaattaacaactacaagaatccgaagctcactagaatgctgacttttaagttctacatgccgaagaaggctaccgagctgaagcacctgcagtgtctcgaagaggagctgaagcccctggaagaagtcctgaatttggcgcaaagcaaaaactttcacctccggccacgcgacctcatctcaaacattaacgtgatcgtcttggagctgaagggctccgaaaccaccttcatgtgtgaatatgccgatgaaacggcgaccatcgtcgaatttctgaatcggtggattactttctgccaaagcatcatctcgaccctgacc

SEQ ID NO: 33345 - DNA, 459 bp, Artificial Sequence
  Description of Artificial Sequence: Synthetic coding sequence
atgtaccggatgcaactgctctcctgtatcgctctatccctggcactggtcaccaacagtgcccccacaagtagcagcaccaagaaaactcagctgcaactggagcacttgctgcttgatctgcagatgatactcaatggaataaataattacaagaacccaaaacttacccgcatgcttacctttaagttctacatgccgaagaaggcaacggaactgaagcacctgcaatgcctggaagaggaactgaaacctctggaagaagtcctgaatctggctcagagtaagaacttccatctacgcccgagggacctgattagtaacattaacgtgattgtgctggaattgaaaggctccgagactaccttcatgtgtgaatacgctgacgagacagcaacgatagtggaattcctaaaccggtggataacattctgtcagtcaattataagcacactaaca

SEQ ID NO: 33346 - DNA, 459 bp, Artificial Sequence
  Description of Artificial Sequence: Synthetic coding sequence
atgtaccgcatgcagctcctttcatgcatcgccctgtcactcgcactcgtgacgaattcagccccaacttcgtcgtccaccaaaaagactcagctgcaactcgagcacctgcttctggaccttcaaatgatcctcaacggaatcaacaactataagaacccgaagctgactcggatgctcacttttaagttctacatgcccaagaaggcaactgaactgaaacatctgcagtgtctggaagaagagcttaagccgctcgaggaagtgttgaacctggcccaatcgaagaactttcacctgcggccgagggatcttatctccaatatcaacgtgatcgtgctcgaattgaagggaagcgaaaccacctttatgtgcgaatacgcggacgagacggccactattgtcgaattcctcaaccgctggattactttctgtcagtcgataatctcgaccctgacc

SEQ ID NO: 33347 - DNA, 459 bp, Artificial Sequence
  Description of Artificial Sequence: Synthetic coding sequence
atgtacaggatgcaactattgtcctgtattgcactgtcgttggccttggtgacaaactccgccccaacctcctcaagtaccaaaaaaacccagctgcagctggaacacctgctactggatctgcaaatgattctaaacggaatcaacaactataagaatcccaagctgacccgtatgctgactttcaagttttacatgcccaaaaaggccacggaactaaagcaccttcagtgtctggaagaggaattaaaaccgctcgaggaagtcctaaatctggcccaatccaaaaatttccacctgcgccccagagaccttatctctaacattaacgttatcgttctggaactgaaaggatccgagacgacgtttatgtgcgagtacgctgatgaaacggctacaatcgtggagttccttaataggtggatcacattttgccaaagtataattagtactttgacg

SEQ ID NO: 33348 - DNA, 459 bp, Artificial Sequence
  Description of Artificial Sequence: Synthetic coding sequence
atgtaccgtatgcagctgctgtcctgtatcgcactctccctggccctcgtgacgaacagcgcacctacctcgtcctcgaccaaaaagactcagttgcaacttgaacatctcctgctcgacctccagatgatactgaacgggattaacaactacaagaacccaaagctgaccaggatgctcaccttcaagttttacatgcctaagaaagcaactgagctgaagcacctccaatgtctcgaagaagagctcaaaccccttgaagaagtgcttaatctcgcacaatcaaaaaactttcatcttcgccctagggatctcatctccaatatcaatgtcattgtcctggagctcaaaggctccgaaaccactttcatgtgcgaatacgcagacgaaactgctactattgtggaattcctcaatagatggataacgttctgtcaatcgatcatcagcactctgacc

SEQ ID NO: 33349 - DNA, 459 bp, Artificial Sequence
  Description of Artificial Sequence: Synthetic coding sequence
atgtatcgaatgcagttactaagttgtattgccctcagcctagcccttgtgaccaattccgctcctacttcctcatcaaccaagaaaacccagctccagctggagcatctcttgctggatcttcagatgatccttaacgggattaataattataaaaaccccaagctgaccaggatgctcacttttaaattttatatgcccaaaaaggcaaccgaactgaagcaccttcagtgtctggaggaagagctcaagcccctggaggaagtcttgaacctggcacagtcgaagaatttccacctcagacctagagaccttatcagcaatatcaatgttatcgtgctagaattgaaaggctcagagacaacatttatgtgtgaatacgccgatgaaacagctacaattgtcgaattcctgaatcgttggatcacattttgtcagagtattatttccacactgacc

SEQ ID NO: 33350 - DNA, 459 bp, Artificial Sequence
  Description of Artificial Sequence: Synthetic coding sequence
atgtatcggatgcaactactcagctgcatcgcactctcgttggcgctggtgacgaacagtgcgcccacctcctcatctaccaagaagactcaactgcaacttgagcacttgcttcttgatctgcagatgatcctgaacggcatcaacaactacaagaacccgaaactcactagaatgctcacctttaagttctatatgcctaagaaagcaaccgagcttaagcacttgcagtgcctcgaagaggagctcaagcccttggaggaggtcctcaacctggcacagtctaagaatttccatttacgcccccgggacctcatctctaacatcaacgtaatagtactcgagctgaagggctcggaaaccaccttcatgtgtgagtatgctgatgaaaccgccacgattgtcgagttccttaaccggtggattactttttgtcagtcgattatcagcaccctcacc

SEQ ID NO: 33351 - DNA, 459 bp, Artificial Sequence
  Description of Artificial Sequence: Synthetic coding sequence
atgtaccggatgcagcttctgagctgtattgccctgagtctcgcgctcgtcacgaacagcgcccccacatcatcatccaccaaaaaaactcagcttcaactggaacacctgcttttggacttgcagatgatcctgaacggaattaataattacaagaatcctaagctcacccgcatgctcactttcaaattctacatgccaaaaaaggctacagaactgaagcacctgcagtgtctggaagaagagctcaaacctctggaggaggtgcttaatctggctcagtctaaaaatttccacctgcgacctagggatttgatctctaacatcaacgtgattgtcctggaactgaagggctctgagaccacgttcatgtgtgaatacgctgacgagacagccactatcgtagagtttctgaataggtggataactttttgccagagcatcataagcacccttaca

SEQ ID NO: 33352 - DNA, 459 bp, Artificial Sequence
  Description of Artificial Sequence: Synthetic coding sequence
atgtacaggatgcaactccttagctgtatcgcactttcacttgcactggtcaccaactccgcccctaccagctcctcgaccaaaaagactcaattgcagcttgaacatctgctgctggatcttcaaatgatcctgaacggaatcaataactacaagaacccaaagctgacccgcatgcttacctttaagttctatatgcctaaaaaggcgacggaacttaagcacctgcagtgcctggaagaagagcttaagccacttgaagaagtgttgaacctcgcccagtccaaaaactttcacctcaggccgcgtgatctgatcagcaacatcaatgtcatagtgcttgaactcaagggctccgaaaccaccttcatgtgtgagtacgccgacgaaaccgcaacgattgtggagtttctgaataggtggattactttctgccaatcgatcatttcgacgcttact

SEQ ID NO: 33353 - DNA, 459 bp, Artificial Sequence
  Description of Artificial Sequence: Synthetic coding sequence
atgtaccgaatgcagctgctgtcctgcattgccttgtccctcgcgctcgtgacgaattctgcccctacatccagcagtacgaagaagacgcagctgcagttagagcatttgctgctggacctccagatgattctgaatggaataaataactacaagaatccaaaattaacacgaatgctcacattcaagttctatatgcccaaaaaggctactgaattaaaacaccttcaatgtctagaagaagagctaaaaccgctggaagaagtcttgaacttggcacagtcaaagaattttcatctgaggcctcgcgacttgatcagtaacattaacgttatcgtcttagaattaaagggttctgagacgacattcatgtgtgagtacgccgatgaaacagctacgattgtagaattcttgaaccgttggattacattctgtcagtccattatctcaactttgacg

SEQ ID NO: 33354 - DNA, 459 bp, Artificial Sequence
  Description of Artificial Sequence: Synthetic coding sequence
atgtataggatgcagctcctctcatgcattgctttgagcctggccctggtcacaaactcagcacccacttcatctagcaccaagaaaactcagctgcagttggaacacctgctgctggaccttcagatgattctcaatggaatcaataattataagaaccctaagctgacccgcatgttgacattcaaattctatatgcctaagaaggccaccgaattgaagcacctgcagtgcttggaagaggaactgaaacctttggaagaggtgctcaacttggctcagtccaagaactttcatttgagaccacgtgatcttatctcaaacattaacgtgattgttctggaactcaaaggctctgaaactaccttcatgtgcgaatacgctgacgagacagctactattgtagagtttctcaataggtggataaccttctgccagagcattatatccaccctgacc

SEQ ID NO: 33355 - DNA, 459 bp, Artificial Sequence
  Description of Artificial Sequence: Synthetic coding sequence
atgtatcggatgcagctgttgtcctgcatcgctctcagtctggccctggtcaccaacagtgcacctacatcaagctctacaaaaaagacacagttgcagttggagcacctgctacttgacctgcaaatgattctcaatggaattaacaattacaagaatccgaagctcacccgaatgctgacctttaaattttacatgccgaagaaggctactgagttaaaacacctgcagtgtcttgaggaggagttgaaaccactagaggaagttctgaacctggctcagagcaagaattttcacctgaggccgcgagacctgatctcaaacatcaatgtgatcgtgctcgagctcaaaggctcagagactacattcatgtgcgagtatgcagacgagaccgccactatcgtggagttcctaaatcgctggatcacattttgccagagcattatcagcactctaact

SEQ ID NO: 33356 - DNA, 459 bp, Artificial Sequence
  Description of Artificial Sequence: Synthetic coding sequence
atgtataggatgcagcttttgtcttgcatcgcactgagcctggcattagttacaaactccgccccaacaagctcaagcaccaagaaaactcaactccagctggagcacctgctgcttgaccttcagatgatcctcaatggaattaacaactacaaaaaccctaagctgaccagaatgcttacattcaagttctatatgccaaaaaaggctaccgagctgaagcacctccaatgtctggaagaagaactgaagcctttggaagaagtgttgaatttggcccagagcaagaatttccacttacggccccgggacctgatatcaaatatcaatgttatcgtattggaactgaaaggctccgagacgacattcatgtgcgagtacgccgatgagactgctactatagtggagttcctcaaccgctggataacattttgtcaaagtataattagtacactcacg

SEQ ID NO: 33357 - DNA, 459 bp, Artificial Sequence
  Description of Artificial Sequence: Synthetic coding sequence
atgtatcgcatgcagctgctgagctgtatagccctctccctggccctggtgactaacagcgctcctacctcgagctctactaaaaagactcaattgcagttagaacatctgctcctggacctccagatgattctgaatggcataaataactacaagaatcctaagctgacccgtatgcttacgttcaagttctatatgcctaagaaggccacggaacttaagcacttgcagtgtctagaagaggagctgaaaccgctagaggaggtgctcaatctggcccaaagcaagaattttcatctgcgtccgcgagatctcatttctaatattaatgtgattgttctggagctcaagggatccgagacaacctttatgtgtgagtacgctgatgagaccgccacgatcgtggagttcctgaaccgttggataacgttctgtcagagcatcatctctacacttacc

SEQ ID NO: 33358 - DNA, 459 bp, Artificial Sequence
  Description of Artificial Sequence: Synthetic coding sequence
atgtacaggatgcaattgcttagctgcatagccctttcgcttgcactggtgactaattcggcgcccacctcttcgtccactaagaaaactcagctgcaactggagcacttgctccttgaccttcagatgattctgaatggtattaacaactacaagaatcctaaacttactagaatgctcacttttaagttttacatgccgaaaaaggcaactgaacttaaacatctgcaatgcctggaggaagagttgaagcctctcgaagaggtgctcaacctggcacagagcaagaacttccatcttagaccccgtgatctgatatcaaacatcaacgtcattgtgctggagcttaaagggtccgagactactttcatgtgtgaatacgcagatgaaaccgcaaccattgtggaatttcttaaccggtggattactttctgccaatcgatcatctccactctgacc

SEQ ID NO: 33359 - DNA, 459 bp, Artificial Sequence
  Description of Artificial Sequence: Synthetic coding sequence
atgtacaggatgcagcttcttagttgtatcgccctttccttggcccttgttactaatagtgccccgacgagctcctcaacaaagaaaacacagttgcaactggagcacctgttgctcgatttgcaaatgatcttaaacggcatcaacaactacaagaaccccaaactcacgagaatgcttacatttaagttctacatgccaaagaaagccaccgaactgaaacaccttcaatgtcttgaagaagagctaaagcctctcgaagaagtccttaaccttgcgcagtctaagaactttcatctccgaccgagagaccttatcagtaatataaacgtaattgttttggaactaaagggaagcgaaacaacgttcatgtgtgaatacgccgacgaaaccgctaccatagtggaattcttaaatcggtggatcacattctgccaaagtatcattagcacgctcact

SEQ ID NO: 33360 - DNA, 459 bp, Artificial Sequence
  Description of Artificial Sequence: Synthetic coding sequence
atgtatcggatgcaactcttgagctgtatagcactgtcactggccttggtaacaaatagtgcccccacgtcctcttctaccaagaaaacccagctccagctggagcatcttcttctagatttgcaaatgatactgaatggcattaataattacaagaatcctaaactaacccggatgcttacctttaagttctacatgccaaagaaagccaccgagctgaagcatctccagtgtttggaggaggaactgaagccactggaagaggttctgaatttggctcagagtaaaaactttcatctcaggcctagggacttaatctcaaatatcaacgtgatcgtgctggaactcaaggggagcgagaccacgtttatgtgcgaatacgcagacgagacggcaaccatcgtcgagttcctgaatagatggatcaccttctgtcagtcgattatctccactctgacg

SEQ ID NO: 33361 - DNA, 459 bp, Artificial Sequence
  Description of Artificial Sequence: Synthetic coding sequence
atgtaccggatgcagttgctgtcctgtatcgccctgtctctcgcactcgtaactaactctgctccaaccagcagcagtacgaagaagacccagctgcaactagaacacctcctcctcgacctgcagatgattctcaacggcatcaacaattacaaaaatccaaagctcaccaggatgttgaccttcaaattctacatgcccaaaaaggccaccgaattgaagcacctccagtgtttagaggaggagttgaagcccctggaggaagtcctcaacctggcccagtccaagaatttccacctgcgtcctagagatctgatcagcaatatcaatgtgatcgtgctggaacttaagggctctgagaccacctttatgtgcgagtatgcggacgaaaccgccacaattgtggagttcctgaacaggtggatcactttttgtcaaagtataataagcactttaaca

SEQ ID NO: 33362 - DNA, 459 bp, Artificial Sequence
  Description of Artificial Sequence: Synthetic coding sequence
atgtaccgaatgcaacttcttagctgtattgccctatcattggctctcgttactaactccgcacccacttccagtagcaccaaaaaaactcagctccagctggaacacctattgttggatttgcaaatgatcctgaatgggattaacaattacaaaaaccctaagctgactcgaatgctgaccttcaagttctacatgcctaaaaaagctacagagctgaaacacctgcagtgcttggaggaggaattgaagccgctcgaggaggtccttaatctcgctcaatcaaaaaattttcacttgcgcccgcgagatctgatcagtaatattaatgtaatagtgcttgagttgaagggctctgagactacctttatgtgcgagtatgccgatgagactgcgacgatcgtggagttcctcaataggtggataacattctgtcagagcataatcagcacactgacc

SEQ ID NO: 33363 - DNA, 459 bp, Artificial Sequence
  Description of Artificial Sequence: Synthetic coding sequence
atgtaccgaatgcagctgctcagctgtattgcactctcgctcgctctggttactaacagcgcccctacctcgagctcgaccaaaaagactcagcttcagcttgaacatctgttgcttgacctgcaaatgattcttaatggtattaacaattacaaaaacccgaaacttactaggatgctgactttcaagttttacatgcccaagaaggcgaccgagcttaagcacctccaatgtcttgaagaagaactgaagccactggaggaagtgcttaacttggcgcaatccaagaactttcatctcagaccacgagatttgatctcgaacattaacgtgattgtgctggaactgaaagggtccgaaaccacgttcatgtgcgagtacgccgatgaaactgcaactattgtggaatttcttaaccgctggatcacgttctgtcaatcgataatcagcactttgacc

SEQ ID NO: 33364 - DNA, 459 bp, Artificial Sequence
  Description of Artificial Sequence: Synthetic coding sequence
atgtacaggatgcagctgttgagctgtattgctttgtctttagctttggtaacgaattccgccccaaccagcagctcgaccaagaaaacccaactgcagttggaacacctgctgcttgatctccagatgattttgaatggcatcaacaattacaaaaaccccaagcttacaaggatgctcacatttaagttttatatgcctaagaaggctacagaactgaagcatctgcagtgcttagaagaggagcttaaacctctagaggaggttctcaacctggctcagtctaaaaactttcacctgaggccaagagaccttatttcaaatatcaacgtgatagttctggagctgaaggggtcagagaccactttcatgtgcgagtacgccgacgagactgccaccattgtggaattcctgaaccggtggattacattctgtcagtcgattatcagtactctgaca

SEQ ID NO: 33365 - DNA, 459 bp, Artificial Sequence
  Description of Artificial Sequence: Synthetic coding sequence
atgtatcgaatgcagctactctcctgcattgctctgagcctggctctcgtgactaactccgcccccacgagcagttccactaagaaaacgcaactgcagctcgagcatcttttgctggatttgcaaatgattctaaacggcatcaataattacaagaatcccaaactgacccggatgctaaccttcaagttttacatgccaaaaaaagccaccgagttaaaacacttacaatgcttggaagaagaattgaagcctctggaagaggtgctgaacttggcccaaagcaaaaattttcatctgcggcctagggacctgatctcaaacatcaacgtcattgtgttggaactgaaaggaagcgagaccacatttatgtgcgagtatgccgatgagactgcaaccatcgtggaattcctgaatcggtggatcacattctgtcagtccattatctctaccttaacc

SEQ ID NO: 33366 - DNA, 459 bp, Artificial Sequence
  Description of Artificial Sequence: Synthetic coding sequence
atgtatagaatgcagctgctgtcttgcatcgccctaagcctggcactggtgaccaattctgccccaacatctagctctaccaaaaaaacccagctgcagctggagcaccttctcctcgatttgcagatgatattaaatggaatcaataattacaaaaatcccaagctgacaagaatgctgaccttcaaattttacatgcctaaaaaagcaaccgagctaaaacacctgcaatgtttggaagaggaattgaagccacttgaagaggtgttaaacctggcacaatccaaaaactttcatttacggccccgggatttaattagcaatatcaacgtcattgtgctggagctgaagggcagtgaaacaaccttcatgtgtgaatacgcagatgagactgctactatcgttgaatttctgaatcgctggataaccttctgtcagtccattattagcacattaaca

SEQ ID NO: 33367 - DNA, 459 bp, Artificial Sequence
  Description of Artificial Sequence: Synthetic coding sequence
atgtaccgcatgcaattgcttagctgcattgctttgtcgctcgcgcttgtgaccaactcagcccctaccagctccagtaccaaaaagacccaactgcaattggaacacctgctcctggacctccagatgattctgaacggaatcaacaactacaagaatccgaaattgacgagaatgctcacgttcaaattctacatgccgaagaaagcaaccgaactcaaacatcttcagtgtctcgaagaagagctcaagccgctggaggaggtcctgaacttggcgcagtcaaagaacttccacctgaggccccgtgatctgataagcaatatcaacgtcatcgtgcttgagttgaaagggtcggaaacgactttcatgtgcgagtatgccgacgaaactgccaccatcgtggaatttctcaatcgctggatcactttttgccagtcaatcatctccactctgacc

SEQ ID NO: 33368 - DNA, 459 bp, Artificial Sequence
  Description of Artificial Sequence: Synthetic coding sequence
atgtaccgtatgcagctgctgagttgcatagctctctcccttgcgttggtcaccaattcagctcctaccagctccagtacaaagaagacccagctccagctggagcatttgttgctggatctgcaaatgatcctcaacgggatcaacaactataagaatcccaaactaacacgaatgctgaccttcaagttctatatgcccaaaaaggcaaccgagctgaagcacttgcagtgcctggaggaggaactgaaaccactggaggaagtgctcaacctggcccaaagcaagaacttccacctacggccgagggatctgatatcaaacatcaacgtcatcgtgctggagctgaaaggttccgagacaacatttatgtgcgaatatgcagacgagaccgccacaattgttgagtttctgaatcgctggatcaccttctgccaatccatcataagcactctgacc

SEQ ID NO: 33369 - DNA, 459 bp, Artificial Sequence
  Description of Artificial Sequence: Synthetic coding sequence
atgtaccgaatgcagcttctgagctgcattgcactgtcactcgcgctggtcaccaacagcgcacctacctcgtcatcgactaagaaaactcaacttcaacttgaacatctgctgctcgatctccaaatgatacttaacggcattaacaactacaagaacccaaagctgactcggatgctgacctttaagttctacatgccaaagaaggcgactgagcttaagcacctgcagtgtcttgaggaggaactcaagcctttggaggaagtgctgaaccttgcacaatcgaagaactttcatctccggccaagggaccttatatcgaacatcaatgtgatcgtcctcgaattgaagggatccgaaaccaccttcatgtgtgaatacgccgatgaaaccgctaccattgtggagtttttgaacagatggattaccttttgtcagtccatcattagcacccttacc

SEQ ID NO: 33370 - DNA, 459 bp, Artificial Sequence
  Description of Artificial Sequence: Synthetic coding sequence
atgtaccgcatgcagctgctgtcgtgtattgcgctttccttggcgcttgtcactaattccgcccctacgtcctcctcgacgaaaaagactcaactccaactggagcatcttctgcttgatctccaaatgatccttaacggaatcaataactataagaacccaaaacttaccagaatgcttaccttcaagttttacatgcctaaaaaggcaactgagcttaagcatcttcagtgtcttgaagaggaactgaaaccactcgaagaagttctgaacttggcacagtcaaagaactttcatttgcgcccacgggatctcatttcgaacattaacgtgatcgtgcttgaactgaaggggtctgagactacgtttatgtgcgaatacgcggacgaaacggcaactattgtggaatttctgaatagatggataactttttgtcaaagcatcatttcgaccttgact

SEQ ID NO: 33371 - DNA, 459 bp, Artificial Sequence
  Description of Artificial Sequence: Synthetic coding sequence
atgtataggatgcagctcctgtcgtgtatcgcattgtctctggcgttagtaaccaattccgcccccactagctcctccaccaaaaagacccagctccaacttgaacaccttctgcttgacctgcaaatgatcctgaatgggataaacaattacaaaaacccaaaactaactaggatgttgacctttaagttctacatgcctaagaaggctactgaactcaaacacctgcagtgcctggaggaggaactcaagccactcgaggaagtgctcaacctagcacagtcaaaaaatttccatcttcggccacgtgacctgatctcaaacataaacgtaatcgtgctggaactcaaaggttctgagaccacttttatgtgcgaatacgctgatgaaactgctactattgtagagtttttaaaccgatggatcaccttttgccagtctattatatccaccctgacc

SEQ ID NO: 33372 - DNA, 459 bp, Artificial Sequence
  Description of Artificial Sequence: Synthetic coding sequence
atgtaccggatgcagttgctcagctgcatcgcactgtctctggcactggtgaccaacagtgcccccacgtcgagcagtactaagaagactcagctgcagttagagcaccttttactggatcttcaaatgattcttaatggaatcaataactacaaaaaccctaagctgacgcgcatgctgacttttaagttctacatgcctaaaaaggccaccgaactgaagcatttgcagtgtctggaggaggagctgaagcctttagaggaggtgctgaacctggcccagagcaaaaattttcatctacgcccccgcgatctgataagcaatattaatgtgatcgtgctggagttgaagggcagcgagaccacctttatgtgtgagtacgcggatgagacggcaaccattgttgagttcctgaatcggtggataaccttttgccaatcgatcatatctactctaacc

SEQ ID NO: 33373 - DNA, 459 bp, Artificial Sequence
  Description of Artificial Sequence: Synthetic coding sequence
atgtacagaatgcagctgctgtcttgcattgccctgagcctcgctctggtcaccaatagcgcccccacatcctcaagtacaaagaaaacacaactccagctggaacacctgctgctggatcttcagatgatacttaacgggatcaacaactataagaatcctaaacttacccggatgttgacatttaagttttacatgccaaagaaggctacagaactgaaacacctgcagtgcctggaggaagagttgaagccactggaggaggttctgaacttggcccagagcaagaatttccacctgcgacccagagacctcatttcaaacatcaatgtcattgtcctggagctgaagggcagtgagacaacgttcatgtgcgagtatgcagatgagaccgccaccatcgtggagttcctcaataggtggattaccttctgccagagtattataagcacattgacc

SEQ ID NO: 33374 - DNA, 459 bp, Artificial Sequence
  Description of Artificial Sequence: Synthetic coding sequence
atgtaccgcatgcagttgctttcttgtatcgcgctgtctctcgccctggtgacaaatagcgcccctacatcaagcagcactaaaaagacgcaattacaattggagcacttactgttggacctgcagatgatcctgaacggcataaataactacaaaaaccctaagctgacccgtatgttaaccttcaaattttacatgcctaagaaagctacagaactgaaacacttgcagtgccttgaagaagaactcaagccgttagaagaagtgttaaacttggcccaaagcaagaacttccacttgaggccacgcgacttaataagtaacattaatgtgattgtgctggagctgaagggctccgagactactttcatgtgcgagtatgctgacgaaactgctaccatagtggagttcctcaaccgctggatcaccttttgccaatccatcataagcactcttaca

SEQ ID NO: 33375 - DNA, 459 bp, Artificial Sequence
  Description of Artificial Sequence: Synthetic coding sequence
atgtaccgaatgcaactgctctcctgcatcgctctcagtctagcccttgtgacaaactccgcaccgacttcttcaagtaccaaaaagacacagcttcagctggagcaccttttacttgatctccagatgatccttaacggaataaacaactataaaaatcctaagctgacgcggatgctgacctttaagttttatatgccaaagaaagcaacagaacttaaacacctgcagtgcctagaagaggagctgaagccactggaagaggtcttaaacctggctcagtccaagaactttcatctgcgtcccagggatctcatctcaaatattaatgttatcgtgctagagttgaaagggtctgagactacatttatgtgtgagtatgctgacgagaccgcaacgatagttgaattcttgaatcgatggattactttttgccaaagcatcatctccacactgacg

SEQ ID NO: 33376 - DNA, 459 bp, Artificial Sequence
  Description of Artificial Sequence: Synthetic coding sequence
atgtaccgcatgcagttgttgtcgtgcattgcactctcgctggcgctggtgaccaactctgccccgacgtcgtcatcaaccaaaaagactcagctgcagcttgaacatctcctgctggatctgcagatgattcttaacggaatcaacaactacaagaacccgaaactgactcggatgctgactttcaaattctatatgccgaagaaggctaccgaactcaagcacctgcaatgcctcgaagaggaactcaaaccactggaggaggtcctgaacttggcgcagagtaagaactttcatctgcggccgcgcgatctcatctcgaatatcaacgtgattgtgctcgaactcaaagggtcagaaaccaccttcatgtgtgaatacgccgacgagactgcaactatcgtggagttcctgaatcgctggatcaccttctgccagtcaattatctccaccctgacg

SEQ ID NO: 33377 - DNA, 459 bp, Artificial Sequence
  Description of Artificial Sequence: Synthetic coding sequence
atgtatcggatgcagctgcttagctgcatcgctctgagcttggctctcgtgaccaactctgcccctacaagctctagcacaaagaaaactcagctccaactggaacacttgctgctcgacctgcagatgattctcaatgggattaacaactacaagaacccaaagctgactcgcatgctcaccttcaaattttacatgccaaagaaagccacggagctgaaacatctccagtgtctggaagaggaactgaaaccgttggaagaggtgcttaaccttgcccagtctaagaactttcacctccggcctcgcgatctgatcagtaacattaacgtgattgtgctggagttgaagggcagcgagactactttcatgtgtgaatatgccgatgaaaccgccaccattgtggaattcctcaatcgctggatcactttttgtcagagcattatttccaccctgaca

SEQ ID NO: 33378 - DNA, 459 bp, Artificial Sequence
  Description of Artificial Sequence: Synthetic coding sequence
atgtacagaatgcagctgttgtcttgcatagcactcagtctggctctggtcactaattccgcacccacgtcttcctccacgaagaagacacagctgcagctagagcacctgctgcttgatctgcaaatgatcttaaacgggattaacaattataaaaaccctaagttaaccaggatgcttacatttaagttttacatgccaaagaaggctaccgaattaaagcacctccaatgcctggaagaagagttgaagcctcttgaggaggtgctgaacttggctcagagcaagaactttcacctgcgacctcgtgacttgattagtaacattaatgtcattgtgcttgagcttaagggcagtgagaccacattcatgtgtgagtacgctgatgagacggccactatcgtggaattcctgaatcgatggataaccttctgtcaaagtataatctccacactcact

SEQ ID NO: 33379 - DNA, 459 bp, Artificial Sequence
  Description of Artificial Sequence: Synthetic coding sequence
atgtaccggatgcagctcctgagctgtattgccctgagcctcgccctggtgaccaattctgccccaacttcaagctctacaaaaaaaacacagctgcagttggagcacttactcctggatctgcagatgatcttgaacggaatcaataattacaaaaaccctaagttaactcgaatgctgacatttaagttctacatgccaaaaaaagcaactgaactgaagcatctccagtgtcttgaagaagagctgaagccactcgaggaagtcctgaacttggcacagagcaaaaattttcacctgagaccccgcgatcttatatcaaacattaatgtgatcgtgttagaactgaaaggaagtgagaccacattcatgtgcgagtatgccgatgagaccgctaccattgttgagttcctgaatcggtggattacgttctgccagtccattatatccaccctgact

SEQ ID NO: 33380 - DNA, 459 bp, Artificial Sequence
  Description of Artificial Sequence: Synthetic coding sequence
atgtatcgtatgcaattactgtcttgtatcgctctttctcttgctctagtgacaaattctgcacccacatccagctcaaccaagaaaacgcaactgcaactagaacatctgctcctggaccttcagatgattcttaacggcattaataattataaaaaccccaagctgacccggatgcttaccttcaagttttacatgcccaaaaaggctacagagttgaagcacctacagtgccttgaagaggaactaaagcctctggaagaggtactgaatctggcccaatctaagaatttccatctgaggcctagggatctgattagtaacatcaatgtgattgtactggagttaaaaggctccgagaccacctttatgtgcgagtacgcagacgaaaccgcaacaattgtcgagttcctgaatcgatggatcactttctgtcaatccatcatctccacattgaca

SEQ ID NO: 33381 - DNA, 459 bp, Artificial Sequence
  Description of Artificial Sequence: Synthetic coding sequence
atgtatagaatgcagctgctctcttgcattgcactcagtttggccttagtgactaactcagccccaacttcttccagtacaaagaagactcagttacagcttgaacatttgctgctggatctacagatgattttgaatggcattaacaattataagaacccgaagctaacgcgcatgctgacttttaagttctacatgcctaagaaggccaccgaactgaagcacctccagtgcctggaggaggagctcaagccgttagaggaggtcctcaacctggcccagagcaagaacttccacctgagaccaagggacctaataagcaacataaacgttatcgtgcttgaattgaaagggagcgaaacaacgtttatgtgcgagtacgctgatgaaactgctacaatcgtcgaattcctcaatcgttggataaccttctgccagagcataatatccacattgaca

SEQ ID NO: 33382 - DNA, 459 bp, Artificial Sequence
  Description of Artificial Sequence: Synthetic coding sequence
atgtacagaatgcagcttctctcctgtatcgcactgtcactagccctcgtgaccaacagcgcacctaccagctcctctactaagaaaactcagcttcagctggagcatcttctgctggacctgcaaatgattttgaatggcattaacaattacaagaaccccaagctgaccaggatgctcacattcaagttctatatgccaaaaaaagccacggagttgaagcacctgcagtgtctcgaagaagagttgaagcccctggaggaggttctgaatctggcccagtctaagaactttcacctgcggcctagggatctgatatccaatatcaacgtgattgtgctggagcttaaggggtctgaaaccactttcatgtgcgagtatgcagatgagaccgccactatcgtcgagttcctgaatcgctggatcacgttctgccaatctatcatctcaacgcttact

SEQ ID NO: 33383 - DNA, 459 bp, Artificial Sequence
  Description of Artificial Sequence: Synthetic coding sequence
atgtacaggatgcaacttctgtcgtgtattgcacttagcctcgccctcgtgacgaattcggcccccacttcatcctctactaaaaagacccaactgcaacttgaacaccttttgcttgaccttcagatgatcctgaatggaatcaacaactacaaaaatccgaaactgactagaatgctcaccttcaagttttacatgcccaagaaggctaccgaactgaagcatttgcaatgtctggaagaggaattgaagcctctggaagaagtgctgaacctggcccagagcaagaacttccatttgaggcctcgagatctcatatcaaacattaatgtcattgtgttggagcttaaagggtccgaaactacttttatgtgcgagtatgcagatgaaacggcgacgattgtcgaatttctgaaccgttggataaccttttgtcagtcgatcattagcaccttgacc

SEQ ID NO: 33384 - DNA, 459 bp, Artificial Sequence
  Description of Artificial Sequence: Synthetic coding sequence
atgtacagaatgcaattgttgtcatgcattgccctttcgctggcccttgtgactaattcggcgccaacttccagttcgaccaagaaaacccagctccaactggagcacctgttgctggacctgcagatgatcctgaacggaatcaacaattacaagaacccgaagctcaccaggatgttgacgttcaagttctatatgcccaagaaggccacggaactgaagcatctccagtgcctcgaagaggagctgaaaccccttgaagaagtgctgaatctcgctcagtcaaagaactttcatctcagaccacgggatctgatctccaacattaacgtcatcgttttggaattgaaaggttcggaaaccaccttcatgtgtgagtacgcggacgaaactgcaactatcgtggagttccttaaccggtggatcacgttctgccagtccatcatttcgaccctgact

SEQ ID NO: 33385 - DNA, 459 bp, Artificial Sequence
  Description of Artificial Sequence: Synthetic coding sequence
atgtacagaatgcagctcctgtcatgcattgcgctttcacttgctctggttactaatagcgcgcctacctcttcatcaactaaaaagacccaactgcaactggagcatctgcttctcgatttgcaaatgatattgaatggcataaacaactataagaaccctaaactgaccaggatgttgacgtttaagttttacatgccgaagaaggcaactgaactcaaacaccttcaatgcctcgaagaggagcttaagcctctcgaagaagtgcttaacctcgcacagtcgaaaaacttccatttgcggccgagagatctgataagtaacattaacgtgatcgtgctggaacttaagggttccgaaaccacttttatgtgtgagtacgcagacgagactgcaactatcgtggagttccttaaccgctggatcactttttgtcagagcattatcagcactcttacg

SEQ ID NO: 33386 - DNA, 459 bp, Artificial Sequence
  Description of Artificial Sequence: Synthetic coding sequence
atgtaccgcatgcaattgctttcctgtatagcactctctttggcattggtgacgaatagcgcccctactagctctagtactaaaaagacgcaacttcaacttgaacatctgctgcttgatctccagatgattctgaatggaatcaacaactacaagaatccaaagctgaccagaatgcttacgtttaagttctacatgcccaaaaaggccaccgaactgaaacatcttcaatgcctcgaagaggaacttaagcctctcgaagaggtgcttaacttggcacagtcaaagaattttcacctgcgaccaagggatcttatttcgaacatcaacgtgattgtcttggagcttaagggttccgaaaccaccttcatgtgtgagtatgctgacgaaaccgcaaccattgtggagtttctcaaccgctggattactttttgtcagtcaataatcagcacgctgact

SEQ ID NO: 33387 - DNA, 459 bp, Artificial Sequence
  Description of Artificial Sequence: Synthetic coding sequence
atgtaccggatgcagcttctgtcatgtattgctctttcccttgcccttgtgactaattcagcacctacgtcgtcctcaactaagaaaactcaactgcagctggagcatcttctgctcgaccttcagatgattcttaacggtattaacaattacaagaaccctaaattgactagaatgctcaccttcaagttctatatgcccaagaaagcgactgaactgaagcaccttcaatgccttgaggaagagctgaagccattggaagaagtattgaatctggcccaaagcaagaactttcatcttcggcccagggatctcatctccaacattaacgttatcgtccttgaactcaagggatcggaaaccaccttcatgtgtgaatacgcagatgaaaccgcaaccatagtggagttcttgaatagatggataacgttttgccagtctattatctcgactcttacc

SEQ ID NO: 33388 - DNA, 459 bp, Artificial Sequence; identical to SEQ ID NO: 33326
  Description of Artificial Sequence: Synthetic coding sequence

SEQ ID NO: 33389 - DNA, 459 bp, Artificial Sequence
  Description of Artificial Sequence: Synthetic coding sequence
atgtatcgcatgcagctgctttcctgtatcgcgctgtcgcttgcactggtgacgaattcggccccgacttcgtcctcgactaagaaaactcaattgcagctggaacatctcctgcttgacctgcaaatgatcctgaacggaatcaacaattacaagaaccccaagctgacccgcatgcttaccttcaagttctacatgccaaagaaagccactgagttgaaacatctgcagtgcctcgaggaagagctgaaacctttggaggaagtgcttaacctcgcacagtcaaaaaacttccacctgaggccgagagatctgatctcgaatatcaacgtgatcgtccttgagcttaagggctccgaaaccacctttatgtgcgagtacgctgatgaaaccgcgactatagtggagttcctgaaccgatggatcactttctgccagtcgatcattagcaccctgacc

SEQ ID NO: 33390 - DNA, 459 bp, Artificial Sequence
  Description of Artificial Sequence: Synthetic coding sequence
atgtatagaatgcaactgctgtcatgcatcgccctttctctcgctctcgtcacaaatagcgcacctacatctagtagtaccaaaaaaacccagctgcaacttgagcacttgctgttggacctccaaatgattctgaacggaattaataactacaagaatcccaaactcactcggatgctgacatttaaattttacatgcctaagaaagctaccgagcttaaacatctgcagtgtctcgaggaggagttgaaaccacttgaagaagtgttgaatctggcacaatctaaaaacttccatctacggccaagggacctcatcagtaacattaatgtcatcgtgcttgagctgaaaggttccgagaccacttttatgtgcgagtacgcagatgaaaccgccacaatcgtggagtttcttaacagatggatcacgttctgccagagcatcatttcaaccctgacc

SEQ ID NO: 33391 - DNA, 459 bp, Artificial Sequence
  Description of Artificial Sequence: Synthetic coding sequence
atgtaccgtatgcaactccttagctgcatagctttatctctggctctggttacgaactcagcccccacctcgagcagcacgaaaaagacacagctacaattagagcatttgctgcttgatctgcaaatgatcttaaacggaattaacaattacaagaatcccaaactcacacggatgctgactttcaagttttatatgcctaagaaagctactgaactcaaacaccttcagtgcttggaggaagagctcaagcccctcgaggaagtcctaaaccttgcacagtccaaaaactttcacctgcgccccagggacctgatctcgaatatcaatgtgattgtcttagagctgaagggcagcgaaacaacctttatgtgtgaatatgctgacgaaactgccactattgtggaatttctgaaccgttggataaccttttgccagagcattatatctactctgacc

SEQ ID NO: 33392 - DNA, 459 bp, Artificial Sequence
  Description of Artificial Sequence: Synthetic coding sequence
atgtatcgcatgcaactgctctcgtgcatcgcgctctcgctggccctggtgactaattccgctccgacttcgtctagcaccaagaaaacccagctccagttggagcatctgcttctggatctccaaatgatcctcaacggaataaacaactacaaaaatccgaagctcactcgcatgctcaccttcaagttctacatgccaaagaaagcaaccgaactcaagcacctgcaatgcctggaggaagaactgaagccgctggaagaagtccttaaccttgcacagtccaaaaacttccatctcaggcctcgcgacctcatctccaacatcaatgtcatcgtcctggagctgaagggttccgagacgactttcatgtgtgaatacgcggacgagacggctaccattgtggagttccttaaccgctggatcaccttctgccaatcaatcatctccactctgacc

SEQ ID NO: 33393 - DNA, 459 bp, Artificial Sequence
  Description of Artificial Sequence: Synthetic coding sequence
atgtaccgtatgcagctgctgagctgtatcgctttatccctggcattagtgaccaatagcgcgcccaccagtagctctacgaaaaagacccagctgcagctggaacatctgctgttggatctccagatgatactgaatgggattaataactacaaaaatccgaagttgacccgcatgttaacttttaagttctatatgccgaaaaaggccacggagctcaagcacctccagtgcctggaggaggaactgaaaccgttggaggaagtacttaatctcgctcaaagcaaaaacttccacctcagacctagggatctcatctctaatattaatgttattgtgctcgaactgaagggaagtgagaccacctttatgtgcgaatatgctgacgaaaccgcgacgatcgtggaatttctgaatcgctggattactttttgtcagtccataatatcaaccttaaca

SEQ ID NO: 33394 - DNA, 459 bp, Artificial Sequence
  Description of Artificial Sequence: Synthetic coding sequence
atgtatcgtatgcagctcctaagctgcatagctctttcattagccttggtgacaaatagcgcccctacgtcctcctcaacaaaaaagacccaactacagctggagcatctactgttagatttgcagatgatacttaatggaatcaataattacaaaaatcccaagctcacccgtatgttaacattcaagttctatatgcccaaaaaagctaccgaattaaagcaccttcaatgtctagaagaggaactcaagcccttggaagaagttcttaacctggctcaatctaaaaactttcacttaaggccgagagatctaatctctaatataaatgtgattgtgttagagctaaaggggagtgagacaacttttatgtgtgagtatgctgacgaaactgcaaccattgtcgagtttctcaacaggtggatcactttctgccaatcaattatcagcaccttaacc

SEQ ID NO: 33395 - DNA, 459 bp, Artificial Sequence
  Description of Artificial Sequence: Synthetic coding sequence
atgtacaggatgcagctgcttagctgcatcgctctgagtctcgcccttgtaacaaactccgctcccacatcaagcagtaccaagaaaactcagctgcaattggagcacctgctgctcgacctccagatgattttgaacggaattaacaattacaagaatccaaaattaaccaggatgttaacgttcaagttttatatgccaaagaaagctaccgagctgaaacacctgcagtgcttagaggaggaattaaagcctctggaggaagtgctgaacctggcgcaaagcaagaactttcatctaaggccccgagatctaatctcgaacatcaacgtgattgtgctggagttgaaagggtccgaaaccaccttcatgtgcgagtacgccgatgagaccgccaccatcgtcgaattcctgaaccgctggatcaccttttgccagtcaatcatctcaaccctgact

SEQ ID NO: 33396 - DNA, 459 bp, Artificial Sequence
  Description of Artificial Sequence: Synthetic coding sequence
atgtacaggatgcagttactttcctgtatcgctctgtccctggcactggtgaccaattcggccccaactagcagttcaaccaaaaaaactcaactacagctggaacacctgttgcttgacttgcaaatgattctgaatggcatcaataactacaaaaatcccaaattgaccaggatgctgacattcaagttctatatgcccaaaaaggccactgagttgaagcacttgcaatgcctcgaggaagagctgaagcccttggaggaggttctgaatctggcgcagagtaagaatttccacctaaggcctagggatctgatcagcaatattaatgtcatagtgctggaactcaagggatccgaaaccactttcatgtgtgaatatgctgatgagaccgcaactatcgttgagttccttaacagatggatcacattctgtcagagcataattagcacactgacc

SEQ ID NO: 33397 - DNA, 459 bp, Artificial Sequence
  Description of Artificial Sequence: Synthetic coding sequence
atgtaccgaatgcagcttcttagctgcattgccctgagtctggctctggtgacaaactctgccccgacaagtagtagtacaaagaaaacacaactgcagctggagcacctgttactcgacttacagatgattttgaatggcattaacaattacaagaatccaaaattaactagaatgctaacatttaagttttacatgccaaagaaggctactgagctgaagcacctgcagtgcttagaggaggaactgaagccactagaggaggtgttaaacctagcccagtctaaaaattttcacctgaggcctagagatttaatttctaacattaacgtcattgtgctcgaactaaagggctccgagacaacctttatgtgcgaatacgccgatgaaactgctactatcgtggagtttctcaacaggtggatcaccttttgccaatctattatttcaacattgacg

SEQ ID NO: 33398 - DNA, 459 bp, Artificial Sequence
  Description of Artificial Sequence: Synthetic coding sequence
atgtaccgcatgcaacttctgtcgtgtatcgcgctttccctggccctggttaccaactcagcaccaacgtcgagcagcactaagaaaactcaattgcagcttgagcacctccttctggacctgcagatgattcttaatggtataaacaattacaaaaacccaaaactgacgcgcatgttgacctttaagttctacatgccgaagaaggctaccgagcttaaacatcttcagtgcctggaagaggaactgaaacccctggaagaagtcctcaacctcgcccagagcaagaatttccaccttcgccctcgcgatcttatctccaacatcaatgtgattgtgctggaattgaagggctcagaaacgacttttatgtgtgaatatgctgatgagactgcgaccatagtcgaattccttaatagatggatcaccttttgtcaatccattatctccacccttact

SEQ ID NO: 33399 - DNA, 459 bp, Artificial Sequence
  Description of Artificial Sequence: Synthetic coding sequence
atgtaccgaatgcaactcctgtcctgcattgcactgtcccttgcattggtcactaactccgctccgacgtcatcctcaaccaaaaagacccagttgcagttggaacacctcctgctggatctgcaaatgatccttaacggaatcaacaattacaagaacccgaaactgaccagaatgctgaccttcaagttctacatgcctaagaaagccactgagctcaagcatctgcagtgcctggaggaagaacttaagccactcgaggaggtgcttaacctggctcagtcaaaaaacttccatctccgcccaagggacctgatctccaatatcaacgtgattgtgctggagctcaaaggatctgaaacgacgtttatgtgtgaatacgccgatgagactgccaccatcgtggaattcctgaaccgctggatcactttctgtcaatccatcatctcgactctgacc

SEQ ID NO: 33400 - DNA, 459 bp, Artificial Sequence
  Description of Artificial Sequence: Synthetic coding sequence
atgtaccggatgcagctgctgtcttgtatcgccctttcgctggctttggtcaccaactccgcgcccactagctcaagcacgaagaaaacccaacttcaactggaacatctgttgctggatctgcagatgatcctgaatggaatcaataactacaagaacccaaagctcactaggatgctcacttttaagttttacatgccgaaaaaggctaccgaattgaagcacctgcaatgccttgaagaggagctgaaaccgctcgaggaggtcctcaatttggcacagtcgaaaaacttccacctgcgtccacgagatctgatctccaacatcaatgtgatagtgctcgaactgaagggcagtgaaactactttcatgtgcgaatatgccgacgagactgccaccattgtggaattcctgaaccgctggatcacgttctgccagtctatcatttcgaccctgacc

SEQ ID NO: 33401 - DNA, 459 bp, Artificial Sequence; identical to SEQ ID NO: 33375
  Description of Artificial Sequence: Synthetic coding sequence

SEQ ID NO: 33402 - DNA, 459 bp, Artificial Sequence
  Description of Artificial Sequence: Synthetic coding sequence
atgtacagaatgcagctcctctcatgtattgctctttctcttgctctggtgaccaacagcgctcctacctcgtcgagcaccaagaaaacgcaattgcagcttgaacatctccttttggatcttcagatgatcctcaatggtattaacaactacaaaaatccgaagttgacgcggatgctgaccttcaagttttacatgcccaagaaagcgaccgagcttaaacacctgcaatgtctcgaagaggaactcaagccccttgaagaggtcctgaacctggcacaaagcaagaactttcacttgaggccacgcgatcttatttccaacattaacgtgatcgtgctggagctgaagggctcagaaacgacgttcatgtgcgaatatgccgacgaaacggcaaccatcgtcgaatttctgaatcgttggattactttctgtcagagcatcatatcgactcttacc

SEQ ID NO: 33403 - DNA, 459 bp, Artificial Sequence
  Description of Artificial Sequence: Synthetic coding sequence
atgtaccgcatgcaactcttgagttgcatcgccttgagcctcgcgctggtgactaactccgcccctacttcgagctccaccaaaaagacccagctccagcttgagcacctcctgcttgacctccagatgatcctgaacggaatcaacaattacaaaaacccgaagttgacgagaatgctgaccttcaagttctacatgccaaagaaagcgaccgaactgaagcatttgcaatgtctcgaggaggaattgaaaccattggaggaagtgcttaatctcgcccagtcgaagaatttccacctcagaccccgcgacctcatctcgaatatcaacgttattgtcctggaattgaagggctccgaaaccacctttatgtgcgaatatgcagatgaaaccgccaccattgtggagtttttgaacaggtggatcaccttctgtcagagcatcatcagcactctcacc

SEQ ID NO: 33404 - DNA, 459 bp, Artificial Sequence
  Description of Artificial Sequence: Synthetic coding sequence
atgtatcggatgcaactgctctcatgcatagctctctcactggcactggtcactaactcagccccgacgtcctcgtctaccaaaaaaacacagctacagctagagcacctactattggacctgcagatgatccttaacggaatcaataactataaaaaccctaaactgacacgtatgctcacattcaaattctatatgcctaaaaaggccaccgagttgaaacatctgcagtgtcttgaggaggaactaaagcctctggaggaggtgctgaatctggcgcaatccaagaattttcacctgcgcccgcgcgacctgatcagcaacataaatgtgattgtgctggagctcaagggatcagagactactttcatgtgcgaatacgccgatgagactgcaacaatagtagaattcctgaaccgatggataaccttctgccaaagtattattagtacactgacg

SEQ ID NO: 33405 - DNA, 459 bp, Artificial Sequence
  Description of Artificial Sequence: Synthetic coding sequence
atgtacaggatgcaacttcttagctgtatcgctctttctcttgcactggtcaccaattccgctccgacgtcgtcctcgactaagaaaactcaactgcaacttgagcaccttcttctcgatcttcaaatgatccttaacgggattaacaactacaagaatccaaagctgacgagaatgctgacctttaagttttacatgcctaagaaggcgactgaactcaagcacctgcaatgtctggaggaagaattgaaaccactcgaagaggttcttaatctggcacaatccaaaaacttccatcttcgcccacgtgatctcatctcgaacataaacgtgattgtgctggagcttaaaggatcagaaaccacctttatgtgcgaatacgccgacgaaaccgccacgattgtggagttcctgaatcgttggatcaccttctgccaaagcattatcagcactctgacg

SEQ ID NO: 33406 - DNA, 459 bp, Artificial Sequence
  Description of Artificial Sequence: Synthetic coding sequence
atgtacaggatgcagctgctttcctgcatcgctctgagcctggccctggtcactaattccgcgccgacctcgtcgtcaactaaaaagactcagctgcaactggaacacttgctcctggatctgcagatgatcctcaacggcattaacaattacaagaacccaaagctcactagaatgttgacgtttaagttctatatgccaaagaaggcaactgagctgaagcacctgcagtgcctcgaggaggaactcaagccgctggaagaagtgttgaatctggcacaatcgaagaacttccatctgcggcctagagatctcatctcaaacatcaacgtgatcgtcctggagctgaagggttcggaaaccacgtttatgtgcgagtatgcagatgaaacggcaaccatcgtggaatttctcaaccggtggatcaccttctgtcagtccatcattagcactctgacc

SEQ ID NO: 33407 - DNA, 459 bp, Artificial Sequence
  Description of Artificial Sequence: Synthetic coding sequence
atgtatcgcatgcagcttctttcctgcattgcattatcgttagcgttggttactaatagcgcaccaacgagcagttccaccaagaaaacccagctccagcttgaacacctcttgttggaccttcaaatgatccttaatgggatcaataattataaaaaccccaaactcacacgaatgctgacgtttaagttttatatgcccaaaaaagcaaccgaacttaaacaccttcagtgcctagaggaggagctcaagcctctggaagaggtgctgaatctggcccagagtaagaactttcatctgagacctagggatttaatctccaacattaatgtgattgtgcttgaactaaagggcagcgagactacctttatgtgtgagtacgctgacgagaccgccacaatcgtggaattcttgaatcgttggatcactttctgtcagagcattattagcacgttgacg

SEQ ID NO: 33408 - DNA, 459 bp, Artificial Sequence
  Description of Artificial Sequence: Synthetic coding sequence
atgtatcgaatgcaattactatcgtgtatagcgttatcgctagcgttagtaacgaattcggcgccgacgtcgtcgtcgacgaaaaaaacgcaactacaactagaacatctattattagatctacaaatgatactaaatggtataaataattataaaaatccgaaactaacgcgtatgctaacgtttaaattttatatgccgaaaaaagcgacggaattaaaacatttacaatgtttagaagaagaattaaaaccgctagaagaagtactaaatttagcgcaatcgaaaaattttcatttacgaccgcgtgatctaatatcgaatataaatgtaatagtactagaattaaaaggttcggaaacgacgtttatgtgtgaatatgcggatgaaacggcgacgatagtagaatttttaaatcgttggataacgttttgtcaatcgataatatcgacgctaacg

SEQ ID NO: 33409 - DNA, 459 bp, Artificial Sequence
  Description of Artificial Sequence: Synthetic coding sequence
atgtacaggatgcaacttctttcgtgcattgcactgtcgctcgctcttgtcacgaattcagcccccacctcgtcgtcaacgaaaaagactcagctgcaactcgagcacttgctgcttgatctgcaaatgatacttaatggaatcaacaactacaagaatcctaaactgacccgaatgctgaccttcaagttctacatgccaaagaaggccactgagctcaagcatctgcagtgcctggaagaagaactgaagccacttgaggaagtcctgaacctggcacaaagcaagaattttcatctgcgccctcgcgatctcatttccaacataaatgttatcgtgcttgagctgaagggcagcgagactacctttatgtgtgaatacgcagatgaaacggcaaccatcgtggagttcctcaacaggtggattacgttttgtcagtctattatctcgaccttgact

SEQ ID NO: 33410 - DNA, 459 bp, Artificial Sequence
  Description of Artificial Sequence: Synthetic coding sequence
atgtacaggatgcaactccttagctgtatagccctttcgcttgccttggtcacgaacagcgcaccgaccagctcctcaactaaaaagacccagcttcaactcgaacatttgcttctggatttgcagatgattcttaacgggatcaataactacaaaaaccctaagctgactagaatgttgacttttaagttttacatgccaaagaaagcgactgaactgaagcacctgcagtgcttggaagaggaactgaagcctctcgaggaagtcctgaaccttgcgcaatcgaagaattttcacctcagaccgcgtgacctcatctcgaacattaatgtgatcgtgctggaactgaagggatccgagactacttttatgtgtgagtatgcagatgaaaccgcaaccatcgtggaattcctcaatcgctggattaccttctgccaatccattatctccaccttgacg

SEQ ID NO: 33411 - DNA, 459 bp, Artificial Sequence
  Description of Artificial Sequence: Synthetic coding sequence
atgtaccgcatgcagttgctcagctgcatcgccctttcactggcactggtgactaactccgcgcctactagctccagcacgaagaaaactcagttgcagctcgaacacctcctcctcgacctccaaatgattctgaacggaattaacaactacaaaaacccaaagctcacgcggatgttgaccttcaagttttacatgccgaaaaaggcaaccgaactgaagcatctgcaatgcttggaagaagaactgaagccgcttgaggaggtgctgaacctggcacagtcgaagaattttcacctgcggccacgtgatctgatctcaaacatcaatgtgatcgtcctcgagctcaagggaagcgaaaccaccttcatgtgcgaatacgcagacgagacggccaccatagttgagtttctgaaccgatggatcactttctgccagtccattatctcgactctgacc

SEQ ID NO: 33412 - DNA, 459 bp, Artificial Sequence
  Description of Artificial Sequence: Synthetic coding sequence
atgtacagaatgcagttgctgtcctgtatcgcattgtcactggctctcgtgaccaacagcgccccgacgtcctcctccaccaaaaagacgcagctgcaattggagcacctcctgcttgacctgcagatgattctgaatgggatcaacaactacaagaatcctaaactgaccagaatgcttaccttcaaattctacatgcccaaaaaggcgactgaactcaagcaccttcagtgtctggaggaagaactcaagccgctggaagaagtgctgaaccttgcgcagtcaaagaactttcacctgcgcccacgggacctcatctcgaacatcaatgtcatcgtcctggaactgaagggatcagagactactttcatgtgcgaatacgccgatgaaactgccaccatcgtggagtttctgaatcggtggatcaccttttgccagtcgattatctcgacccttacg

SEQ ID NO: 33413 - DNA, 459 bp, Artificial Sequence
  Description of Artificial Sequence: Synthetic coding sequence
atgtacagaatgcaattgctttcctgtatagcactctctttggccctggtgaccaactcagcgcctacttcatcctctactaagaagacacagctacaactggagcacctgttgctcgacttgcagatgatcctgaatggcattaacaactacaaaaatcctaaattgacgagaatgctgaccttcaaattctacatgcctaagaaggctacagagttaaaacatttgcagtgccttgaggaggagttaaagcctctggaggaggtgctgaatctggcccagtctaagaactttcacctcagaccgcgtgacctgatttcaaacataaatgtaatagttctggagctgaagggcagtgagaccacattcatgtgtgagtacgcagacgagacagctaccatcgtggagtttctgaaccgttggattaccttttgtcagagcattatatctacactgacg

SEQ ID NO: 33414 - DNA, 459 bp, Artificial Sequence
  Description of Artificial Sequence: Synthetic coding sequence
atgtatcgcatgcaacttctatcttgcatagccctgagtttggccctggtgacaaacagcgccccaacctctagttccactaaaaagacacaactccagttggagcatctcttacttgacctgcagatgattttgaatggtatcaataactacaaaaaccctaaacttacaaggatgctgacctttaaattttatatgcccaagaaggctacggaattaaagcacctgcagtgcctcgaggaggagctgaaacctctcgaggaggtcctgaatctggcccagtctaaaaattttcatctcaggccccgcgacctgatttctaacattaacgtgatcgtgctggagctgaaaggaagcgaaacaaccttcatgtgtgagtatgctgacgaaacagcgacaatagtggagttcctcaacagatggataacattttgtcagtccatcatttctacattgaca

SEQ ID NO: 33415 - DNA, 459 bp, Artificial Sequence
  Description of Artificial Sequence: Synthetic coding sequence
atgtaccgtatgcaactgttgtcttgtattgccctctcccttgctctagtgactaacagcgctcctactagtagctccaccaaaaagacccagctacagttggagcacttactcctggacctccagatgattctgaatggcatcaacaattacaaaaacccaaaactgaccaggatgttgacatttaaattttatatgcccaagaaagcaacggagctgaagcatctgcagtgtttagaggaagagctgaaacctctcgaagaggtgctgaacctggcacagtctaaaaacttccacctacggccgagagatttgattagcaacatcaacgtcatagtgctcgagctaaagggcagtgagactactttcatgtgtgagtatgcagatgagaccgctacaatagttgagttccttaatcggtggataacattctgccaaagcataatctcaacactcaca

SEQ ID NO: 33416 - DNA, 459 bp, Artificial Sequence
  Description of Artificial Sequence: Synthetic coding sequence
atgtaccgtatgcagctcctgtcatgcattgccctgtcgctggccctggttaccaacagcgcgcctaccagctccagcaccaaaaaaacccagctgcagctggagcacttgctcctcgacctgcagatgatcttgaacggtatcaataactacaagaatcccaagttgacgagaatgctgacatttaaattctatatgccaaagaaggcgacggagctgaagcatttgcaatgcttggaggaggagctgaagcctctggaggaggtgctgaacctggcgcaaagcaaaaatttccatctgagacctcgagacttgattagcaacattaatgtcatcgtgctggaactgaagggttccgagacaacgttcatgtgcgagtacgcggatgagaccgcaaccatcgtcgagttcctaaaccgctggatcacgttctgtcagtcaattattagcaccctgacg

SEQ ID NO: 33417 - DNA, 459 bp, Artificial Sequence
  Description of Artificial Sequence: Synthetic coding sequence
atgtacaggatgcagctgctgtcctgtattgccctttcgctcgccctggtcactaattcggctcccacgtcctcctccaccaaaaagactcaattgcaactcgaacatctgctgctggacctccagatgatcttgaatggcatcaataactacaagaacccaaagctgacccggatgcttactttcaaattctacatgccaaagaaggccaccgagctgaaacacctccaatgcttggaggaggaactcaagcctctggaggaggtgcttaacctcgcccagtccaagaacttccacctcagacctcgcgatctgatttcaaacatcaacgtgatcgtgctcgaacttaaaggttctgaaaccacgtttatgtgcgaatacgcagacgaaaccgcgaccattgttgagtttcttaatcgctggatcactttctgccagtcaatcatctccacgctgact

SEQ ID NO: 33418 - DNA, 459 bp, Artificial Sequence
  Description of Artificial Sequence: Synthetic coding sequence
atgtaccggatgcagttgctgagctgcatcgcactctccctcgcactggtgactaattcagctcctacttcgtcatcaaccaagaaaacccaactgcagctcgaacacctcctgctggatctgcagatgatcctgaacggcatcaacaattacaaaaaccctaagctgaccaggatgctgacctttaagttctacatgccgaagaaggcgacggaactcaagcatcttcagtgcctggaggaagagctcaaaccacttgaagaagtcttgaacctcgcccaatcgaaaaacttccacctgcgcccgcgagacttgattagcaacatcaatgtgattgtgcttgaactgaaggggtcggaaacgacttttatgtgtgaatacgccgatgaaaccgccaccatcgtcgagtttctgaaccggtggatcaccttctgccagtcgatcatctcgactctcacc

SEQ ID NO: 33419 - DNA, 459 bp, Artificial Sequence
  Description of Artificial Sequence: Synthetic coding sequence
atgtacagaatgcaactgctgtcctgcattgctttgagtttagcacttgtgacgaattcggcgccgacctcgagcagcaccaagaagacccagctccaacttgaacatcttctgctggacctacagatgatcctgaatgggatcaataattacaagaatcccaaattgacccgcatgctgacgtttaaattctacatgccaaagaaagccacagagctgaagcatctccagtgcttagaggaggagcttaaaccgttggaagaagtgctgaatctggcacagtccaagaattttcacctgagacctcgggatctaattagcaacataaacgtgatagttttggagttgaagggcagtgaaaccacgtttatgtgcgagtatgccgacgagacagcgaccatcgtcgagtttctgaacagatggattactttctgccagagtatcatatccacactgact

SEQ ID NO: 33420 - DNA, 459 bp, Artificial Sequence
  Description of Artificial Sequence: Synthetic coding sequence
atgtaccgtatgcaattgctctcttgcatcgctttgtcccttgcactggtgactaacagcgctcctacctcatcctcaaccaaaaagactcagctgcagcttgaacatctccttctggatctccagatgattttgaacggtattaacaactacaagaaccccaagctgacacgcatgctgactttcaagttctatatgcccaagaaagctactgagctcaagcacctgcagtgcctcgaagaagagttgaagcctctcgaggaggtgctgaaccttgctcagagtaagaactttcacctgaggccccgtgacttgatcagcaacatcaacgtgatcgttctcgagctgaagggtagtgagactacctttatgtgtgagtacgcagacgaaactgccacaatcgtggagttcctgaacagatggatcaccttctgtcagtcaatcatctctacattgaca

SEQ ID NO: 33421 - DNA, 459 bp, Artificial Sequence
  Description of Artificial Sequence: Synthetic coding sequence
atgtaccgaatgcaactgcttagctgcatcgcgctctccctcgcgcttgtgaccaactcggcgcccacctcaagttcgaccaaaaagacccagctgcagctcgaacaccttcttctggatttgcagatgatcctcaacggcatcaataactataagaaccccaagctgacccggatgttgaccttcaaattctacatgccgaagaaggccactgaacttaagcatctccaatgtctcgaagaggaactgaaaccattggaagaggtcctgaacctcgctcagtccaagaatttccacctgcgcccgcgcgacttgatttcgaacatcaatgtgattgttcttgagctgaaggggtccgaaaccacgttcatgtgcgagtacgcagacgaaaccgccactatcgtggagttcctgaatagatggatcaccttttgccaatcgataatctcaactctgact

SEQ ID NO: 33422 - DNA, 459 bp, Artificial Sequence
  Description of Artificial Sequence: Synthetic coding sequence
atgtataggatgcaacttctttcttgtattgcattaagtcttgcattagttacaaatagtgcaccaacaagttcatctactaaaaaaactcaacttcaacttgaacatcttttgttagatcttcaaatgattcttaatggaataaataactataagaatcctaaattgacacgtatgcttacatttaaattttatatgcctaaaaaggcaactgagttaaaacatcttcaatgtcttgaagaagaacttaaaccattagaagaagttttaaatttagctcaatcaaaaaatttccatcttagacctagagacttaatatctaatattaatgttattgttttagaattaaagggtagtgaaactacattcatgtgtgaatatgcagatgaaactgcaactattgtagaattcttaaatagatggataactttctgtcaatcgattatttcaaccttaaca

SEQ ID NO: 33423 - DNA, 459 bp, Artificial Sequence
  Description of Artificial Sequence: Synthetic coding sequence
atgtaccgaatgcagctcctttcctgtatagcgctctcacttgccctggtcacgaacagcgcacctacctcctcctcgacgaagaaaactcaattgcagcttgagcacctgcttcttgatttgcagatgatcctcaacgggattaacaattacaaaaacccaaaacttacccggatgctcaccttcaaattctacatgccaaagaaggcaaccgaactcaagcatctgcaatgcctggaagaggaactcaagccactggaggaagtgctcaacctggcacaaagcaaaaactttcatctgcggccccgcgatctcatctccaatatcaacgtcatcgtgctggaactcaaggggtcagagactacctttatgtgtgaatacgcagacgaaaccgcaaccattgtggaattccttaaccgctggattaccttttgtcaaagcataatctcaaccctgact

SEQ ID NO: 33424 - DNA, 459 bp, Artificial Sequence
  Description of Artificial Sequence: Synthetic coding sequence
atgtaccgcatgcagctgctgtcgtgtatcgcactgtctctggccctcgtgactaacagcgcccccacgtcatcctcgactaaaaagactcaactgcaactggaacacctgctgttggacctccagatgattctgaatggcatcaataactacaagaacccgaaacttaccaggatgctgacctttaagttctacatgccaaagaaagcgaccgaacttaagcatctccaatgccttgaggaggaactcaagcctctggaagaagtgctgaacttggcccagtccaagaacttccacttgcggccgcgcgatctgatctccaatatcaacgtgatcgtcctcgagctcaagggatcagaaaccacgttcatgtgcgagtacgctgacgaaaccgcgactatcgtcgagttcctcaatagatggatcactttttgccagtcgattatcagcaccctgacc

SEQ ID NO: 33425 - DNA, 459 bp, Artificial Sequence
  Description of Artificial Sequence: Synthetic coding sequence
atgtacaggatgcaactcttgtcctgcatcgccctctctctggctctggttactaattcggcgccgacctcctcctccaccaagaagactcaactgcaacttgaacatctccttctggacctgcagatgatattgaacgggatcaacaattacaagaatccaaagttgacgcgcatgcttaccttcaagttttacatgccgaagaaggcgaccgaacttaaacacctgcagtgcctggaagaagagctgaagccgctcgaagaggtcctgaatctggcccagtccaaaaacttccacctgcgcccccgggacctgatctcgaatatcaatgtgattgtcttggaattgaaaggaagcgaaactactttcatgtgcgagtatgccgacgaaaccgcgaccatcgtcgaattcctcaaccgatggatcacgttctgtcagtccatcatctcaaccctcacc

SEQ ID NO: 33426 - DNA, 459 bp, Artificial Sequence
  Description of Artificial Sequence: Synthetic coding sequence
atgtaccgcatgcaacttctttcgtgtattgcactgtccttggcacttgtgacgaatagcgcgcctacctcctcaagcactaaaaagacccagcttcaactggaacatctgctgttggatcttcagatgatcctgaatgggatcaacaactacaagaatccaaagctgacccgtatgctcacgttcaaattctacatgccgaagaaggccaccgagctgaagcacctgcaatgccttgaagaagaactgaagcctctggaggaagtcctcaatctggcacaatcgaaaaacttccatctgcgacccagagatcttatttccaacattaacgtgattgtactcgaactgaagggctcggaaactaccttcatgtgtgaatacgccgatgaaaccgcaactattgtggagtttctcaacagatggattactttctgtcagagcataatctctactctcacc

SEQ ID NO: 33427 - DNA, 459 bp, Artificial Sequence
  Description of Artificial Sequence: Synthetic coding sequence
atgtaccgcatgcagctcctttcatgcatcgcattgtcgttggcgctggtgaccaacagcgccccgacctcaagctcgactaaaaagacccaactgcagctcgaacacctgctgctggacctccagatgatactgaacggaatcaacaactacaagaatcctaagttgactcgcatgctcacctttaagttttacatgccaaaaaaggcgaccgagcttaagcaccttcagtgcttggaagaagaactgaagcctctggaggaggtgcttaatctggcccaatccaagaatttccatctcaggccgagggatctgatctccaacatcaatgtgatcgtcctcgagctgaagggttccgagactacgtttatgtgcgagtacgcggacgaaactgccaccatcgtcgaatttctgaatcgctggatcaccttctgtcagtccatcatcagcaccttgacc

SEQ ID NO: 33428 - DNA, 459 bp, Artificial Sequence
  Description of Artificial Sequence: Synthetic coding sequence
atgtaccgaatgcagcttctaagctgcattgcgctgtctctggcgcttgtcactaattcagcaccaacatcatcctccacgaaaaaaacacagctccagctagagcatctgctcttggacttacaaatgatcctgaatgggatcaacaactacaagaatcccaagctcacccggatgctgacattcaaattctacatgcctaaaaaagcaaccgagctcaaacacctgcagtgtcttgaagaagaactgaaacccctcgaggaggtactgaatttggcacagtcaaagaacttccacctgcgcccgagagacctgatcagcaatatcaacgtgatagtgctagagctcaaagggagtgaaaccacatttatgtgcgagtacgcagatgagaccgcgactatcgtggagtttctgaataggtggataacgttttgccaatctattatctccaccctgacc

SEQ ID NO: 33429 - DNA, 459 bp, Artificial Sequence
  Description of Artificial Sequence: Synthetic coding sequence
atgtataggatgcagctgctgtcctgtattgccctctcactggccctggtaactaacagcgcaccaacctcaagctccactaagaagactcaactgcaactcgaacacctgttactagacctgcagatgattctcaacggcataaacaattataaaaatcccaagcttaccagaatgttgacattcaaattctacatgccaaaaaaagcaacagaactgaaacacctccagtgcctagaggaagagctgaaacccctggaggaggtactgaatctagcccagagtaagaactttcacctgcggccccgcgacctcataagtaacattaatgtgatagtcctagagctcaagggctctgagaccacattcatgtgtgagtatgccgacgaaaccgccacaattgttgagtttctgaaccgatggattacattttgccagagcatcatctcgactcttacg

SEQ ID NO: 33430 - DNA, 459 bp, Artificial Sequence
  Description of Artificial Sequence: Synthetic coding sequence
atgtatcgcatgcagctgctttcctgcatagcactgtcccttgcactggtgaccaactcagcgccaacttcgtcctcaaccaaaaagacccagctccaacttgaacatctccttcttgatctgcaaatgatcctgaacggaatcaataactacaagaacccaaaactgacccggatgctgacttttaagttttacatgcctaagaaggccaccgaacttaagcacctccagtgcctggaagaagaactcaagccgctggaagaagtgcttaacctggctcagtccaaaaactttcatctcagaccccgggacttgatcagcaacataaacgtgatagttctggaactgaaaggttcagagacgacgtttatgtgcgaatacgcagatgaaaccgctacgattgtggagttcctcaaccgatggatcaccttttgtcagtcgatcattagcaccctgact

SEQ ID NO: 33431 - DNA, 459 bp, Artificial Sequence
  Description of Artificial Sequence: Synthetic coding sequence
atgtaccggatgcagctgctgtcctgtatcgccctgagcctggcccttgtgaccaatagcgctccaacatcctcctcgacaaaaaaaacccaactccaactggaacacctgctcttagaccttcagatgatcttgaacggtataaataattataagaatcccaaactgactcgaatgctgacattcaaattctatatgcccaagaaggccacggagctaaaacatctgcaatgtctggaggaggagctcaagcctctggaggaggtgcttaacctcgcacagtctaaaaacttccacttgcggcccagggacctcatctccaacataaacgtcattgtgcttgagcttaagggcagtgaaacgacctttatgtgcgagtatgccgacgaaacagccacaatcgtggagttcctgaaccggtggattacattttgtcagagtattatttcaaccctgact

SEQ ID NO: 33432 - DNA, 459 bp, Artificial Sequence
  Description of Artificial Sequence: Synthetic coding sequence
atgtacagaatgcagctcctgtcatgcatcgccctgtcattggcgttggtcacgaacagcgctccgactagctcctccaccaaaaagacgcaactgcagctcgagcacctcctgcttgacttgcagatgattctgaacgggatcaacaattacaagaacccgaagctgaccaggatgctcacctttaagttctatatgccgaagaaagccactgaactcaagcaccttcagtgtctggaggaagagctgaaaccgctggaggaagtcctgaatctggcgcaatccaagaattttcacctccgtccccgggacctgatttcgaacatcaatgtgatcgtgctggaactcaaaggatcagaaactacgttcatgtgtgaatacgcggatgagacggcaaccatcgtggaatttctgaacaggtggatcactttctgccaatcgatcatctcgaccctcact

SEQ ID NO: 33433 - DNA, 459 bp, Artificial Sequence
  Description of Artificial Sequence: Synthetic coding sequence
atgtataggatgcagttactctcttgtatagccctgtctctggcactggtgacaaactccgctcctacaagctcatccaccaagaaaacccaactgcagctagagcatctgctcctcgatcttcagatgatcctgaatggaatcaataattataagaacccgaagttgacgcggatgttaacattcaagttctatatgcctaagaaagctacggaattgaaacatctacagtgtctggaggaagaactcaagcccctcgaggaggtgctgaatctggcccaatcaaagaatttccatttgcgaccacgagatctcatatccaacatcaatgtgatcgtgttagagctgaagggttctgaaacgacttttatgtgtgagtacgcagacgaaactgctactatcgttgaattcttaaatcgctggattaccttctgccagtctatcatcagtactttgaca

SEQ ID NO: 33434 - DNA, 459 bp, Artificial Sequence
  Description of Artificial Sequence: Synthetic coding sequence
atgtatcggatgcagcttctgtcgtgcatcgcgctgtcgttggcgcttgtgaccaattcagcccccacttcctccagcactaagaaaacgcaattgcaactcgaacaccttcttctggacctccagatgatcttgaacggcatcaacaactacaagaacccgaagctgactcggatgctgacgttcaagttctacatgccaaagaaggccaccgaactgaagcacctgcagtgcttggaggaagagctgaagcctctggaggaggtcttgaatctggctcagtcgaaaaactttcatctcagacctagggatctgattagcaacattaatgtgatcgtgctggagctgaaaggatcagaaactacttttatgtgtgaatacgcagacgaaacggcaaccatcgtcgaattcctgaatcgttggattaccttctgccaatccatcatctcaaccttgacc

SEQ ID NO: 33435 - DNA, 459 bp, Artificial Sequence
  Description of Artificial Sequence: Synthetic coding sequence
atgtatagaatgcagttactttcctgcattgcacttagccttgctctggtgaccaactctgcaccgacatcttcctctactaagaagacacagttacaactcgaacaccttttactggacctgcagatgattctgaacgggattaacaattacaaaaaccccaaactgacccggatgctgacgttcaagttctacatgcccaagaaggctaccgagctgaaacacttgcagtgcctggaggaagagcttaaaccactggaggaggttctcaatctggcccagagcaaaaacttccaccttagacctcgcgacttaatttcaaatatcaatgtgatcgtcttggagcttaaggggtcagaaacaacttttatgtgcgagtatgcagatgagacagccactatcgtcgaattccttaacaggtggataaccttttgccagtccatcatttccacgctgacc

SEQ ID NO: 33436 - DNA, 459 bp, Artificial Sequence
  Description of Artificial Sequence: Synthetic coding sequence
atgtacaggatgcagctactaagctgcatagctctgtctctggcgcttgtcactaacagtgcacccacctctagctcgaccaagaaaactcagctgcagctcgaacacttgctgctggatcttcagatgatcctgaatgggattaacaactacaagaaccccaaactgaccaggatgctcaccttcaaattctatatgccaaagaaagccacagagttaaagcatttgcagtgtctagaggaggaactgaagcccttggaagaagtgcttaatttggcacagtccaaaaactttcacctccggcccagagatctaattagcaacattaacgtgatcgtactagaattaaagggaagtgagacaacttttatgtgcgagtacgctgacgaaaccgcaacgatcgtggaattcctgaataggtggatcaccttttgccagtccataatcagtacccttacc

SEQ ID NO: 33437 - DNA, 459 bp, Artificial Sequence
  Description of Artificial Sequence: Synthetic coding sequence
atgtatagaatgcaactcctctcatgcatcgcactgtcactggcactggtgactaacagcgcgccaacttcatcgtcgaccaagaaaacccaacttcagctggagcatctccttctggatctgcagatgatcctgaatggcatcaacaactacaaaaacccgaaactgacgcggatgcttaccttcaagttctacatgccgaaaaaggccaccgaactgaaacacctgcaatgtttggaggaagaactgaagcctttggaggaagtccttaacctggcacaatccaagaatttccacctgcgtccacgcgacctcatatctaacatcaatgtcatcgtgttggaactcaagggatcggagactacgtttatgtgtgagtacgccgacgagactgctactattgtggaattcctgaatcgctggattaccttctgtcagtccatcatttcgaccctcact

SEQ ID NO: 33438 - DNA, 459 bp, Artificial Sequence
  Description of Artificial Sequence: Synthetic coding sequence
atgtatcggatgcagctgcttagctgcattgccctctcattagcgttggttactaactctgcaccgacgagctctagtacaaaaaagacccagctgcagcttgaacacctgctcctggacctccagatgattttaaatggtattaataattacaagaatccaaagctgacgaggatgctgaccttcaaattctacatgcccaaaaaagccaccgagcttaaacacctacagtgtttggaagaagagttgaagcctctcgaggaggtgctcaacctggcccagtccaagaacttccacctgaggcctcgcgatctgatttctaacatcaatgttatagtgctggaattaaagggctccgaaactacctttatgtgtgagtatgccgacgaaaccgcaaccatcgtggagttcctgaatagatggatcacattttgtcagagcatcatctccacactgact

SEQ ID NO: 33439 - DNA, 459 bp, Artificial Sequence
  Description of Artificial Sequence: Synthetic coding sequence
atgtacagaatgcaactgctgtcgtgtatcgcattgtcgctggcacttgtgactaattcagcaccgacttcgagctcgactaaaaagacccagcttcaattggaacatctgctgcttgaccttcagatgattttgaatgggatcaacaactacaagaacccaaagctgaccaggatgctcacttttaagttttacatgccaaagaaagcaaccgaactcaaacatctccaatgccttgaagaagaactgaagccactggaggaagtgctgaatctggcccagtcgaagaatttccatctccgtcctagggatcttatctcgaacatcaacgtcattgtgctcgagctgaaaggaagcgaaactacttttatgtgtgaatacgcagatgaaacggccaccatagtcgaattccttaaccgatggattactttttgtcagtccatcataagtactctgacc

SEQ ID NO: 33440 - DNA, 459 bp, Artificial Sequence
  Description of Artificial Sequence: Synthetic coding sequence
atgtaccggatgcagctgctcagctgtattgcgctctctctcgcactcgtcactaactcggcaccaacgtcctcatctactaagaaaacccagctgcaactggagcaccttcttctcgatcttcaaatgattcttaatggtatcaataactacaagaatcctaaactgactaggatgctgacctttaagttctacatgccaaaaaaggcaacggaactgaaacatcttcaatgccttgaagaagagcttaagccgctggaggaggttcttaatctggcccagtcgaagaacttccatctgcgcccccgcgacctgattagcaacatcaacgtaattgtcttggaacttaagggatcggaaactacgtttatgtgtgaatatgcagatgaaaccgccaccatcgtggaattcttgaaccgatggataactttttgtcaatcgattatctcgaccctcacc

SEQ ID NO: 33441 - DNA, 459 bp, Artificial Sequence
  Description of Artificial Sequence: Synthetic coding sequence
atgtacagaatgcaactgctcagctgcatcgcattgagcctggctttggtgaccaactccgccccgactagctcgtccactaagaaaacccagttgcaacttgagcatctgcttctggacctgcagatgatcctgaacggtatcaataactataagaacccgaagctcactcggatgctgaccttcaaattctacatgcctaaaaaggcaaccgaattgaagcacttgcagtgtctggaggaagaacttaagcccctcgaagaggtcctcaatcttgcccaatctaagaatttccacctgcggccgcgcgatcttatttccaacatcaatgtgatcgtcctggagctgaaaggatcagagactaccttcatgtgcgaatacgcggacgaaacggcgaccattgtagagttcctgaaccgctggatcaccttttgccagtccataatctcgacgctcact

SEQ ID NO: 33442 - DNA, 459 bp, Artificial Sequence
  Description of Artificial Sequence: Synthetic coding sequence
atgtatcgcatgcagttgttgagttgtatagccctgagcctggcgctggtgaccaattccgctccaacatccagctccactaagaagacccagctccaactggagcacttgttgttggacttgcaaatgattctgaacggaatcaacaactacaaaaaccccaagctgaccaggatgctgactttcaagttttacatgcccaaaaaggctactgagttgaaacatttgcagtgcctggaagaagaactgaaacccctcgaagaggtcctgaacctcgcccagagcaagaattttcacttgcgcccgcgcgaccttatctctaatattaacgtaattgtgttggaactcaagggcagcgaaaccacttttatgtgcgagtacgctgacgagaccgctactatcgtggagttcctgaacagatggattactttttgtcaaagcatcatttctacactgacc

SEQ ID NO: 33443 - DNA, 459 bp, Artificial Sequence
  Description of Artificial Sequence: Synthetic coding sequence
atgtaccgcatgcagctcctctcgtgcatcgctctgagtcttgccctcgttaccaactccgcacccacatcaagtagtactaaaaagactcagctgcaattagagcatctccttctggacctccagatgattctcaacggtatcaacaactacaagaatcccaaacttaccagaatgctgacatttaagttttacatgccaaagaaagctacagaactgaagcacctgcagtgcctcgaggaggagctaaagccacttgaggaggtgctgaacctcgcccaatcaaagaattttcacctacgcccaagggacctcatctctaacatcaatgttatcgtacttgagctcaagggaagcgagaccacatttatgtgcgagtacgctgacgaaactgctactattgtcgagttcctgaatcgttggattaccttctgccaaagtatcatttccaccctcacc

SEQ ID NO: 33444 - DNA, 459 bp, Artificial Sequence
  Description of Artificial Sequence: Synthetic coding sequence
atgtaccgcatgcagcttctgtcctgcattgcgctgagtctcgctctggtgaccaattccgccccaacatcatcctccaccaagaaaactcaattgcaactagaacatctgctgctggatctgcagatgatcctgaatggtatcaacaactacaagaaccctaaactgacacggatgctgactttcaaattttatatgccaaagaaagccaccgaacttaaacacttgcagtgtctcgaagaggagctaaagcccctggaagaagtgctgaacctagctcagtcaaagaactttcatttgcgccccagggatctgatcagtaatatcaacgtgattgtattggaactgaaagggagcgagaccacctttatgtgcgaatatgccgatgagaccgctactatcgtggaatttctgaataggtggattactttttgccagtcaattatctcaacgttgacc

SEQ ID NO: 33445 - DNA, 459 bp, Artificial Sequence
  Description of Artificial Sequence: Synthetic coding sequence
atgtacagaatgcaactgctttcatgcattgcgttgtcgctggcgctcgtgaccaactccgctcccacctcgtcgagcaccaaaaagacccagcttcagctcgaacatcttctgttggacctgcagatgattcttaacggcatcaataactacaagaatccaaagctgaccagaatgcttacttttaagttctacatgccgaagaaggcgacggaactgaagcatcttcagtgcctggaggaagaacttaaaccacttgaagaggtgctgaacctggcacagtcgaaaaacttccatcttaggcctagggatctgatttccaacattaacgtgatcgtgcttgaacttaaaggatcagaaacgactttcatgtgtgagtacgcagatgaaactgcaacgattgtggagttccttaacagatggataactttttgccaatcgattatctccactcttacc

SEQ ID NO: 33446 - DNA, 459 bp, Artificial Sequence
  Description of Artificial Sequence: Synthetic coding sequence
atgtaccgcatgcaattgctgtcatgcatcgcactgtctctggctcttgtgaccaactccgctccgactagctcctcaacgaagaaaacccagctgcagcttgaacatctgcttctggacctgcagatgatcctcaacggaatcaataactacaagaatccgaagctgactcggatgctgaccttcaaattctacatgccgaagaaagctaccgagcttaagcacctgcaatgcctggaagaagagctgaagccgctggaagaagtgttgaacctcgcgcagtcgaagaatttccacctgcgcccgagggatctcatctcgaacatcaatgtgatagtgttggagctgaagggctccgaaaccaccttcatgtgcgagtatgccgacgaaaccgctaccattgtcgagtttttgaaccggtggatcactttctgtcagtcgatcatttcgaccctcacg

SEQ ID NO: 33447 - DNA, 459 bp, Artificial Sequence
  Description of Artificial Sequence: Synthetic coding sequence
atgtatcggatgcagctactctcttgtatagccctgtcactcgctcttgtcactaattcagcccctacttcttcctctacaaagaagactcagcttcagctcgaacacctgctattagacctccaaatgatactaaacgggataaataactacaaaaacccgaaacttacacgaatgctaactttcaagttttatatgcccaaaaaagccacagagttgaaacacttacagtgcctagaagaggaactgaaaccactcgaagaagtgttgaatctggcccagtccaaaaattttcatttgagacctagagatctcatctcgaatataaacgtgatcgtgctcgaactcaaggggtccgaaactacttttatgtgtgaatatgctgacgaaacagccacaatcgtcgaattcctcaatcgctggattacattctgccagtctatcatctcaacactgaca

SEQ ID NO: 33448 - DNA, 459 bp, Artificial Sequence
  Description of Artificial Sequence: Synthetic coding sequence
atgtataggatgcagctgctctcttgcatcgctctttcactcgccctggtcactaattctgcgcccacctccagttctacaaaaaagacacagctccagctggaacatttactcttagatcttcagatgattctcaatggcattaacaactacaaaaacccgaagctgacccgaatgctgaccttcaaattttatatgccgaaaaaagccacagaactgaagcatctgcagtgcttagaagaggagctgaagccactggaagaggtgctgaacctggcgcagagtaagaactttcacctaagacccagagacctcattagcaacataaacgtgatcgtactggagttgaagggttccgagactacctttatgtgtgaatacgccgacgaaactgcaaccattgttgaatttttgaaccggtggataactttctgtcagtcaattataagtacacttacc

SEQ ID NO: 33449 - DNA, 459 bp, Artificial Sequence
  Description of Artificial Sequence: Synthetic coding sequence
atgtaccgcatgcagttactatcctgcatcgcactaagcctcgctctggtgaccaatagcgccccaacatccagtagtaccaaaaagacacagctccaactggaacacctgcttctagacctgcagatgatcctaaatggcataaataactacaaaaatccaaaattaactagaatgcttactttcaagttttacatgcctaaaaaagccacagagttaaaacacctgcagtgcctggaagaggagctaaagccgttagaggaagtgctgaatctggcccagtcaaagaatttccatctgcgtccaagggatctgattagtaacattaatgtgattgtgctggagctgaagggatccgagaccacattcatgtgtgagtatgctgatgaaactgccactatagttgagttcctcaataggtggataactttctgtcagtcaattatctccacattgaca

SEQ ID NO: 33450 - DNA, 459 bp, Artificial Sequence
  Description of Artificial Sequence: Synthetic coding sequence
atgtatcgcatgcagttgctttcctgcattgcactcagcttggcactggtgaccaactcggcacctacttcgagctccacgaaaaagacccaactccagttggagcacctcctgctcgatctccagatgattcttaatggaattaacaattacaagaacccgaagctgacccggatgcttactttcaagttctatatgcctaagaaggcgacggagctgaaacatctccagtgcctcgaagaggaacttaaacctctcgaggaggtccttaacctggcacagtcgaagaattttcaccttagaccaagggacctgatatccaacatcaacgtcatcgtcctcgaattgaagggaagcgaaaccacctttatgtgtgagtacgctgatgaaacggccactattgtggaatttcttaatcgttggattactttttgccaaagcatcatatctacccttact

SEQ ID NO: 33451 - DNA, 459 bp, Artificial Sequence
  Description of Artificial Sequence: Synthetic coding sequence
atgtaccgcatgcagctgctgtcctgcatcgcccttagcctggccctcgtgacgaacagtgccccgacttcctccagtaccaagaagacccagctgcaacttgagcatttgctgttggatttgcaaatgatacttaacggaattaacaactacaagaacccaaaactgactagaatgctcacgttcaagttctatatgcccaagaaggcgaccgagctcaagcatttgcaatgtctggaggaggagcttaaacctctggaggaagtgctgaatctcgcccagtccaagaactttcacttgaggcctcgggatctcataagcaacatcaatgtaattgtgctggagctcaagggcagtgaaaccacctttatgtgcgagtatgccgacgagaccgctaccatcgttgagttcttgaataggtggatcaccttttgtcaatccatcatatccactctgaca

SEQ ID NO: 33452 - DNA, 459 bp, Artificial Sequence
  Description of Artificial Sequence: Synthetic coding sequence
atgtatcgaatgcaactgttgagttgcatcgctctctcactggcattagttacaaatagtgctcctacaagcagttctacgaaaaagactcagctgcaactcgagcatttgctccttgaccttcaaatgattttgaacggaataaataactataaaaatccaaagcttactagaatgcttacttttaaattttatatgcccaaaaaagctacagagcttaagcacctgcagtgtttggaagaggaacttaagcccttggaggaagttttgaacctcgctcaatctaagaattttcatttaaggccgagggatttgattagcaatatcaatgttatcgttttagaattgaaaggctctgaaacgactttcatgtgtgagtacgcagacgaaaccgctactatagtggagttcttgaacagatggattactttctgtcagagtataatctccactttgaca

SEQ ID NO: 33453 - DNA, 459 bp, Artificial Sequence
  Description of Artificial Sequence: Synthetic coding sequence
atgtaccggatgcaactcctctcctgcatcgcactctcactcgcccttgtgacgaattcagccccgacctcctcctcgactaagaaaacccagttgcagctggagcacctgcttctggacctccaaatgatcctgaacggaatcaacaattacaagaatcccaaactgaccaggatgctgaccttcaagttctacatgccgaagaaggcgactgagctgaagcacctgcaatgcctggaagaagagttgaaaccactcgaagaggtgctgaaccttgcgcagtcgaagaactttcatctcagacctcgcgacttgatctcgaatatcaacgtcattgtcctggaactgaagggcagcgagacgaccttcatgtgcgaatacgctgatgaaactgccaccattgtggaattcctgaaccgctggatcactttttgtcagagcatcatctctaccctgact

SEQ ID NO: 33454 - DNA, 459 bp, Artificial Sequence
  Description of Artificial Sequence: Synthetic coding sequence
atgtacaggatgcagctgctgtcgtgtattgctctgtccctcgcgctggtgaccaactcggcgccgacctcctcctcgaccaaaaagacccagctgcaactggagcacctgctcctggacttgcaaatgatcctgaacgggatcaacaattacaagaacccgaagctcacccgcatgcttacgttcaagttttacatgcccaaaaaggcaaccgagctgaagcacttgcaatgtttggaggaggagctgaagccactcgaagaagtgctgaacctggcccagagcaagaatttccacctgaggccgcgggatctgatcagcaatatcaacgttatcgtgctcgagttgaagggatcggaaactaccttcatgtgtgaatatgcagacgaaaccgccactattgtcgaattcctgaacagatggatcaccttctgccagtccattatctcgaccctcact

SEQ ID NO: 33455 - DNA, 459 bp, Artificial Sequence
  Description of Artificial Sequence: Synthetic coding sequence
atgtaccgaatgcagctcctcagttgtatcgccctctctctggcccttgtaacaaattccgcccccacatcttcatcaacaaaaaagactcagctgcagctggagcacctcctcctcgatcttcagatgatcctcaatgggataaataattacaaaaatcctaaactcacacgtatgctgacatttaaattttacatgcctaaaaaggcaactgagctgaagcacttgcagtgccttgaggaagagctcaagcccctcgaagaagtcttaaatctcgcccagtcaaaaaactttcacctgcggccccgggatctaatttccaatataaatgtgatagtgctcgaactgaaagggtctgaaacaacatttatgtgtgaatatgcagatgaaacggctactatcgttgaattcctgaacaggtggataactttttgccagtctatcatctccactctaaca

SEQ ID NO: 33456 - DNA, 459 bp, Artificial Sequence
  Description of Artificial Sequence: Synthetic coding sequence
atgtacaggatgcagctgctgagttgtatcgcactgagcctcgcactcgttacaaatagcgcccccaccagctcaagcactaagaaaacccagctgcagctggagcatttactcctggatctgcaaatgattctgaatggaatcaataactacaaaaatcctaaactgacccgcatgctcaccttcaaattttatatgcctaaaaaggcaaccgaactcaagcatctgcagtgcctggaagaggaattgaaaccactggaggaagtcctgaatttggctcagtcgaagaacttccatttgcgtccacgcgacttgatttccaatattaatgttatagttctcgagcttaagggttctgaaaccactttcatgtgtgagtatgccgacgaaacggcgaccatcgtcgaatttctcaatcgatggataaccttttgtcaaagcatcatatctaccctgacg

SEQ ID NO: 33457 - DNA, 459 bp, Artificial Sequence
  Description of Artificial Sequence: Synthetic coding sequence
atgtacagaatgcagctgctaagctgtattgccctatctctggcactcgtcactaatagtgcccccacatccagctcaacaaagaagacacaacttcagctagagcacttgctgctcgatctgcagatgatcctaaacggtataaacaattacaagaatccaaaactgaccagaatgctgacctttaaattttatatgcctaagaaagccactgaactgaagcatctccagtgtctggaggaagaattgaagccgcttgaagaggtgctcaatcttgctcagtcaaaaaacttccacctgcgtcccagagacctgatctctaacattaatgtgattgtgttggagctgaagggcagcgagactacgttcatgtgtgaatacgccgacgaaacagctacaatcgttgaattcttaaatcgctggattaccttctgccaatccatcatcagcactctgacc

SEQ ID NO: 33458 - DNA, 459 bp, Artificial Sequence
  Description of Artificial Sequence: Synthetic coding sequence
atgtaccgcatgcaattactctcctgtatcgcgctttctcttgcattggttacaaattccgcaccaacatcttcatcaacgaaaaaaacacaactgcaactcgaacatctgctactcgatcttcaaatgatcttgaatggaattaacaattacaaaaatcctaaacttacccgaatgcttacattcaagttctacatgccaaaaaaggcaacagagctaaaacacttacaatgccttgaagaagaattgaagcctctggaagaagttttaaatcttgctcaaagtaaaaactttcatttacgaccaagagatcttatttctaatatcaacgttattgtactggagctaaaaggttcagagacaactttcatgtgcgaatatgccgatgaaaccgcaactatcgttgaatttttgaacagatggataacattctgccagtcaattataagtactttaact

SEQ ID NO: 33459 - DNA, 459 bp, Artificial Sequence
  Description of Artificial Sequence: Synthetic coding sequence
atgtaccgaatgcagctgctcagttgcatcgccttaagcctagccttggtgaccaactctgcccctacctcctcctcaaccaagaaaacccagttgcaactcgagcatttgctgctggatctacagatgattctgaacggaattaacaattacaagaacccaaagttgactaggatgctcacctttaaattctacatgcctaagaaagcgactgagctgaagcatctccagtgtctcgaggaagagcttaaaccacttgaagaggtcctcaacctcgcccagtcaaagaacttccacctaaggccacgagacctgatatcaaatatcaatgttattgtcctggaattgaagggctcggaaactacttttatgtgcgaatacgctgacgaaactgctacaatcgtggaatttttgaatcgttggataactttctgccaatccattatcagcaccctcacg

SEQ ID NO: 33460 - DNA, 459 bp, Artificial Sequence
  Description of Artificial Sequence: Synthetic coding sequence
atgtaccgcatgcagctcctgtcttgcatcgctttgtctcttgccctggtgaccaacagcgctcctacgtcttcttccacgaagaagacacagctccaactggagcacctgctgcttgatctgcaaatgatccttaacgggattaataactacaagaatcctaaattgaccaggatgctgactttcaaattttacatgccaaagaaagccacagagctcaagcacctgcagtgcttggaggaggagctgaagcccttggaggaagttctcaacctggctcaatccaagaattttcacctgcggccccgagaccttatttcaaacatcaacgtgatagtcctggagttgaagggttccgagactaccttcatgtgtgaatatgctgacgaaactgccaccatagtggaatttctgaaccggtggatcacattctgtcagagtatcatcagtactctgaca

SEQ ID NO: 33461 - DNA, 459 bp, Artificial Sequence
  Description of Artificial Sequence: Synthetic coding sequence
atgtaccgcatgcagctgctgtcctgcatcgcgctgtcgctggccctggtcactaatagtgcccctacctcatccagtaccaaaaagactcagctccaactcgaacacttgctcctggacctccaaatgatactgaacggaatcaataactacaaaaaccccaagctgacccgcatgcttactttcaaattctacatgccgaaaaaggcaaccgaattgaagcatttgcagtgcctcgaagaagagctgaagcctcttgaggaagtgcttaacctggcgcagtctaagaacttccacctgcggccaagagatctgatctccaatatcaatgtgatcgtccttgaactcaagggctcggaaaccacgtttatgtgcgagtacgccgatgaaaccgcaaccattgtggaattcctgaaccgatggatcaccttctgtcaatctatcatctccaccctgacc

SEQ ID NO: 33462 - DNA, 459 bp, Artificial Sequence
  Description of Artificial Sequence: Synthetic coding sequence
atgtatagaatgcaattattatcatgcattgctttatcacttgctctcgtcacaaattctgctccaacatcctcctccactaaaaaaactcagctacaactagagcatcttttgttggatctgcagatgatattgaacggaataaataattacaagaatccaaaactgactcgtatgttgacattcaagttctatatgccgaagaaagcaacagaactgaagcatcttcaatgcctggaagaagaattgaaaccattggaagaggttcttaatttggctcagtcaaaaaacttccatcttcgtccaagagatctcatttctaacatcaatgttattgttctggagcttaaaggttctgaaacaactttcatgtgcgaatacgctgatgaaacagcaactatcgtagagtttcttaatcgatggataacgttctgtcagtcaattatttcgaccctcact

SEQ ID NO: 33463 - DNA, 459 bp, Artificial Sequence
  Description of Artificial Sequence: Synthetic coding sequence
atgtaccggatgcagctgctgagctgcattgcactttccctggcactggtcactaactcggcaccaacctcgtcgtcgactaagaaaacccagctgcaactcgagcatctccttctggatctccagatgatactgaatgggattaacaactataagaaccccaaacttactcgtatgcttacctttaagttttacatgccaaagaaggcaacggaactgaagcatcttcagtgtctcgaagaggagcttaaaccccttgaggaggtcctgaacttggcgcaaagcaagaatttccacttgaggcctagagatcttatttccaacattaacgttatcgtgttggagcttaaaggctcagagactacctttatgtgtgagtacgcagatgagactgcgactatagtggaatttctcaacaggtggatcactttttgtcaatcaattatctccacccttacc

SEQ ID NO: 33464 - DNA, 459 bp, Artificial Sequence
  Description of Artificial Sequence: Synthetic coding sequence
atgtaccggatgcagctcttgtcctgcatagctttgtcacttgcgcttgtgaccaactccgcacctacctcgtcgtccacgaagaaaacccagctgcaactcgaacacctcctcctcgacttgcagatgatcttgaacggaatcaacaactacaaaaatcccaagctgaccagaatgctgacctttaagttctacatgccgaagaaggccactgaactgaagcacctgcaatgcctggaagaggaattgaagccattggaagaggtcctgaacctggcccagagtaaaaacttccatcttaggccgcgcgatctcatatcgaatatcaatgtcatcgtgctcgaactcaaggggtctgagactaccttcatgtgtgagtacgccgacgaaaccgcgactatcgtagagttcctgaaccgctggatcactttttgccaaagcattatctcgactctgact

SEQ ID NO: 33465 - DNA, 459 bp, Artificial Sequence
  Description of Artificial Sequence: Synthetic coding sequence
atgtatagaatgcagcttctgtcatgcatagccctatccttagctttggtcacaaacagcgctccaacaagctctagcacaaagaaaacccaactacagctcgaacacctgctgctggacctacagatgatactcaatggaatcaacaattacaaaaatccgaagctgacaagaatgctgacctttaaattttatatgcctaaaaaggctacagaattgaaacacctgcagtgtttggaggaggagttgaagcccctggaggaagtgttgaatttggcccagtctaaaaactttcacctgagacctagagatctgatatcgaacatcaacgtcattgtcctggagttaaaaggcagcgaaactacttttatgtgcgaatatgccgacgagaccgctacgattgtggagttcctaaaccgatggatcacattttgtcaaagcatcatctctacgctcacg

SEQ ID NO: 33466 - DNA, 459 bp, Artificial Sequence
  Description of Artificial Sequence: Synthetic coding sequence
atgtaccggatgcagctgttgagctgcattgccctctctctcgcacttgtgacaaacagtgctccgacatcctccagtactaagaagacccagctgcagctggagcacctcctgctcgatttacaaatgatcctgaacggaataaataactataagaatcctaaactcacaaggatgctcacttttaagttctacatgcccaaaaaggctacagagctcaagcatctgcaatgccttgaggaggagcttaagccactcgaggaggtgctgaacctcgcccagagtaagaatttccatctgcggcctcgagatcttatctcaaatatcaatgtgattgttctggagctgaaaggctctgaaaccacttttatgtgtgaatacgcggatgagaccgctacgatcgtggaatttttgaaccgctggatcacattttgtcaaagcattatttcgacactgact

SEQ ID NO: 33467 - DNA, 459 bp, Artificial Sequence
  Description of Artificial Sequence: Synthetic coding sequence
atgtaccgcatgcaactgctgtcctgtatcgccctgtcactcgccctggtgactaactccgctcctacctcctcctccacgaaaaagactcagcttcagcttgaacacctcctgctggatctgcagatgatccttaacggtattaacaattacaaaaacccgaagctgacccggatgctgactttcaagttttacatgcctaaaaaggccactgaactgaaacatctgcagtgcctggaggaagagctcaagccactggaggaagtgctcaacctggcacagtcgaagaattttcacctgcggccccgcgacctcatctccaacatcaacgtgatcgtgctggagctgaagggctctgagactaccttcatgtgcgaatacgcggacgagacggccaccatcgtggagtttcttaaccgctggatcaccttttgtcaaagcatcatctcgaccctgacc

SEQ ID NO: 33468 - DNA, 459 bp, Artificial Sequence
  Description of Artificial Sequence: Synthetic coding sequence
atgtacaggatgcagctattatcctgtatagcactttctctggcgcttgtgacaaattctgcccccacttctagttctactaaaaaaactcagctccaactcgaacacctgctcctcgatcttcagatgatcctcaacgggatcaataactacaaaaatcccaaactgactcggatgctcacatttaaattctatatgcccaaaaaagcgacagagctcaaacacctgcagtgcttagaggaggaattaaagccacttgaagaagtactcaatctggctcagtcgaagaacttccatctcagaccaagagatctcattagtaacatcaatgttatcgtgctggaactaaaggggtcagaaacaacattcatgtgtgaatacgccgacgaaactgctactatagtcgaattcttaaatcgatggattacattctgtcagtcgattatatcaacattaaca

SEQ ID NO: 33469 - DNA, 459 bp, Artificial Sequence
  Description of Artificial Sequence: Synthetic coding sequence
atgtaccgtatgcaactgctgtcttgcattgcgctttcactggcccttgtcacaaattctgcgcctacttcatcctcaactaagaaaacgcagctgcaactcgagcatctgctgttggatttacagatgattttaaacggaatcaataactacaaaaacccaaaattaacaagaatgttgacttttaagttttatatgcctaaaaaagcaacagaacttaaacacctgcaatgtcttgaagaagaacttaaacctttagaagaagtgctcaatctggcgcaatcaaaaaactttcatcttcggcctcgagacctgattagcaacattaacgtgattgttttggagctaaaaggttcggagactacttttatgtgcgaatacgcggatgagaccgcaacgatcgtcgaatttctgaatagatggatcacgttctgccaatccatcatttccacgcttacc

SEQ ID NO: 33470 - DNA, 459 bp, Artificial Sequence
  Description of Artificial Sequence: Synthetic coding sequence
atgtatagaatgcaattattatcatgtattgcattatctttagctcttgttacaaattcagcaccaacttcttcatcaacaaagaagactcaattacaacttgagcatttattattagatttacaaatgattttaaatggtataaataattataaaaatccaaaacttacaagaatgcttacatttaaattttatatgccaaaaaaggcaacagaattaaaacatcttcaatgtcttgaagaagaattaaaaccattagaagaagttcttaatttagcacaaagtaaaaattttcatttaagaccaagagatttaatttctaatataaatgtcatcgtacttgaactaaagggaagtgaaactactttcatgtgtgaatacgcagatgaaacagctacaattgttgaatttttaaatcgttggataacattttgtcaaagtatcattagtactttaacc

SEQ ID NO: 33471 - DNA, 459 bp, Artificial Sequence
  Description of Artificial Sequence: Synthetic coding sequence
atgtatagaatgcagctgctgagctgcatagcactgagcctggcactcgtcacaaactcagctcctacaagctcatccactaagaaaacgcagctgcaactggagcatttgctgttggatttgcagatgatccttaacggaattaataattacaaaaaccccaaactgactagaatgctgacatttaaattttacatgcccaagaaggcgacagagctcaagcacctgcagtgccttgaggaggagcttaagcctctggaagaggtgctgaacctggcgcaaagtaagaacttccatctcaggcctagggaccttatctctaacatcaatgtgatcgtcctcgaactgaaaggaagtgaaactactttcatgtgcgagtacgccgacgagacagccaccatagtggagtttcttaacaggtggattaccttttgtcaatccatcatcagcacactgact

SEQ ID NO: 33472 - DNA, 459 bp, Artificial Sequence
  Description of Artificial Sequence: Synthetic coding sequence
atgtacaggatgcaactactctcctgtatcgccttgtctttggccttagtgacgaattcagccccaactagcagcagcactaagaagacccagttgcagctcgaacatttgctgctggatctgcagatgattctgaacggcatcaacaattataaaaatccgaagctgaccagaatgctaacttttaagttctatatgccaaaaaaggctaccgaacttaaacacctgcagtgtctagaagaggagctgaaaccccttgaggaggtactcaatctagcacagtcaaaaaacttccacctgcgcccacgagacttaataagcaatatcaatgtcattgtcctggagctgaagggatctgagacaaccttcatgtgtgaatatgccgacgagaccgcaacgattgtcgagtttctcaacaggtggataaccttctgccagtcaatcatcagtaccttgaca

SEQ ID NO: 33473 - DNA, 459 bp, Artificial Sequence
  Description of Artificial Sequence: Synthetic coding sequence
atgtatcggatgcagctgctgtcctgcatcgctctgagcctggcgctggtgaccaactcggcgccaacttcatcgtccactaaaaagacgcagcttcaactcgagcaccttcttttggatcttcaaatgattctgaatggaataaacaactacaagaatccgaaactgaccagaatgttgacgtttaagttctacatgcccaagaaggctaccgagctgaagcatttgcagtgtcttgaagaagagctgaaacctctggaagaagtccttaacctggcgcaatccaagaatttccatcttcggcctcgcgacctgatttcgaacatcaatgtgatagtgctggagctgaagggttccgaaaccacttttatgtgtgagtacgcagacgaaaccgctaccattgtcgaatttcttaatcgatggattacgttttgtcaatcgatcatttcgactctgact

SEQ ID NO: 33474 - DNA, 459 bp, Artificial Sequence
  Description of Artificial Sequence: Synthetic coding sequence
atgtaccggatgcagctgctgagctgcatcgctctgtcactggctctcgtgaccaactccgcacccacttcgtcgagtaccaaaaagactcaactccagctcgaacatctgcttttggaccttcagatgatcctcaatgggatcaataactataagaacccaaaactgacccggatgctgaccttcaagttctacatgccaaaaaaggccaccgagctcaaacaccttcagtgcttggaggaggaactgaagcctctggaagaagtgcttaaccttgcgcagtccaagaatttccacctgaggcccagggatctgatctccaacattaacgtgattgttctggagctcaagggctcggaaaccaccttcatgtgtgagtacgccgacgaaacggctaccatcgtcgagtttctgaacagatggatcacgttttgccagagcatcatttcgactctgact

SEQ ID NO: 33475 - DNA, 459 bp, Artificial Sequence
  Description of Artificial Sequence: Synthetic coding sequence
atgtacaggatgcagcttctgtcctgcattgcacttagccttgccttggtcactaattccgcgccgaccagctccagcactaagaaaacccaattgcaactcgaacacctcctcctcgacctgcaaatgattttgaacgggattaacaactacaagaaccctaagctgacgagaatgttgactttcaaattctacatgccaaagaaggcgaccgagttgaagcacctgcagtgtctggaagaggagcttaaaccgcttgaggaagtactgaatttggcacaatcgaagaattttcatcttcggcctagggatctgatctcaaacatcaatgtgatagtgctcgaactcaagggttctgaaactacctttatgtgtgaatacgcagatgagacggcgactattgtggagtttctgaaccgttggatcaccttttgccagtcgattatctcgacccttact

SEQ ID NO: 33476 - DNA, 459 bp, Artificial Sequence
  Description of Artificial Sequence: Synthetic coding sequence
atgtatagaatgcagttgctaagctgtatcgcgctgagtctagccctcgttaccaactcagcacctaccagtagcagtaccaaaaagacccagctgcagctcgaacatttgctcctagacctccagatgatcctgaatgggattaataactataagaaccctaaactcacacgcatgctgaccttcaagttttacatgcctaagaaggcaactgaactcaagcatttgcagtgtttagaggaggagttaaagccactcgaggaagtgttgaaccttgcccagagtaagaactttcaccttcgccctcgggatcttatctcaaatatcaacgtcattgtgttggagctgaagggctctgaaacaacattcatgtgtgagtacgcggacgagaccgcaaccatcgtcgagtttctgaatcggtggatcaccttctgtcagtccatcatttcaactctgacc

SEQ ID NO: 33477 - DNA, 459 bp, Artificial Sequence
  Description of Artificial Sequence: Synthetic coding sequence
atgtataggatgcagctgttatcatgcatcgctctaagtcttgccctcgttaccaattccgctccaacctcttctagcacaaagaagacacagcttcagctcgaacacttgctcttggatctgcagatgatcctgaacggaatcaacaactataagaacccaaaactcacccgtatgctcaccttcaagttttatatgcccaaaaaggccacagagttgaagcacctccaatgccttgaggaagaattgaagcctctggaggaagttctgaatttggcccagtccaagaatttccatttaagacctagagacctcatttctaatattaacgttatcgttctggaactgaagggttcagagacaacgttcatgtgcgagtacgccgacgaaaccgcgactatagtggaattcctcaatagatggattaccttctgtcagagcattatcagtaccctcaca

SEQ ID NO: 33478 - DNA, 459 bp, Artificial Sequence
  Description of Artificial Sequence: Synthetic coding sequence
atgtacagaatgcaattgctgagctgcattgccctgagcctggcactggttaccaatagtgccccaacttccagctctacaaaaaaaacccaactgcagctggagcatttgttgctggacctacagatgattctaaatggcataaacaactataagaacccgaagcttacaaggatgctgacctttaaattctatatgccaaagaaggccacggaattgaagcatcttcagtgccttgaggaggaacttaagccactggaggaggtattgaatctcgcacagagcaaaaactttcacttacggccaagagacctcatatctaacatcaatgtaatagtcctggaactgaaggggtcagagacgacttttatgtgcgaatatgctgacgagaccgctacaattgtggaattcctcaacagatggatcacattctgccagagcataatatcaacacttaca

SEQ ID NO: 33479 - DNA, 459 bp, Artificial Sequence
  Description of Artificial Sequence: Synthetic coding sequence
atgtatagaatgcaactgttgtcgtgtatagcactgtcactcgcactggtgacaaatagcgcaccaaccagtagttcaacgaaaaagacccagctgcagctcgagcacctgctgctagatctgcagatgattctgaacgggataaacaattacaaaaacccaaaactgacacggatgctgacattcaagttctacatgcccaagaaagctactgagctgaaacatctgcagtgcttagaggaagagttaaagcctctcgaggaagtgctcaacctggcccagagtaaaaacttccacttacggccacgggacctgatctctaatataaatgtgattgtgctggagctgaaaggaagcgaaactacttttatgtgcgagtacgccgatgaaacagcgaccatcgtagagtttctgaaccgatggatcacattttgccaaagcatcatctccacccttaca

SEQ ID NO: 33480 - DNA, 459 bp, Artificial Sequence
  Description of Artificial Sequence: Synthetic coding sequence
atgtaccgcatgcaacttctgagctgtatagcactgtctttagctctcgtcacgaacagcgctccaaccagttcttcaacaaagaagacacagctgcaactggaacatttactccttgatcttcagatgatcttaaacggcattaacaattataaaaatccaaaattgacacgtatgctgacatttaagttctatatgccgaagaaagcgacagagctcaaacatttacaatgcttggaagaggagctcaagcctctagaggaagttctgaatcttgctcaaagcaaaaattttcatctgcgccctagggacttaatttcaaacattaacgtgattgtacttgagcttaaaggaagcgaaactacattcatgtgcgagtatgcagatgaaaccgctaccatcgtagaattcttaaatcggtggatcaccttttgtcagagtattatttcaacgctaacc

SEQ ID NO: 33481 - DNA, 459 bp, Artificial Sequence
  Description of Artificial Sequence: Synthetic coding sequence
atgtatcgcatgcaacttctctcttgtatagccctgtctcttgcacttgttactaactctgcccccacaagtagtagtactaagaaaacacagcttcaactggaacatctcctccttgatctgcagatgatactgaatgggattaataactacaaaaatccaaagcttacacgcatgctgactttcaagttctatatgccaaaaaaagcaacagagctgaaacacttacagtgcctcgaggaagagctaaaaccactggaggaggtcctcaacctagctcaatctaaaaatttccacctaaggcctcgggatctcatatccaatatcaacgtgatcgtgctggaattaaaagggagtgaaactactttcatgtgtgaatatgccgatgagacagctacaatagtggaattcttaaaccgatggatcactttctgtcagtctataataagtacactgact

SEQ ID NO: 33482 - DNA, 459 bp, Artificial Sequence
  Description of Artificial Sequence: Synthetic coding sequence
atgtaccggatgcaactcctgagctgtatcgccttgtccctggccctcgtgacgaattccgcgcccacctcatcctcaacgaaaaagactcagttgcagctggaacatctgctcttggatcttcagatgatcctgaatggaataaacaattacaaaaaccccaaactcacccgcatgctcacctttaagttttacatgcctaagaaggcaactgagctcaagcatctgcagtgccttgaggaggaactcaaaccattggaggaagtgcttaatcttgctcaaagcaagaactttcatctgcgacctcgagatctcatcagcaacatcaacgtgatcgttctggaactgaagggatcggaaactaccttcatgtgtgaatacgcagacgagacggccaccattgtggaatttctgaacagatggattaccttttgccaatccatcatttcgaccctcact

SEQ ID NO: 33483 - DNA, 459 bp, Artificial Sequence
  Description of Artificial Sequence: Synthetic coding sequence
atgtatcggatgcagctgctctcatgcatagctctatctctggccctggtcacaaactctgctcctacgagttcctccactaagaagacgcaattgcaactggagcatttgctgttggacctccagatgattttgaacggaataaataactataagaatccgaaacttaccaggatgcttacatttaaattctatatgcccaagaaggcaaccgaactcaagcacctgcaatgcctagaggaggaattgaagccactcgaggaggtgctcaatctggcacagtcaaaaaattttcatctgcgtccgagagacctgatcagtaatatcaatgtgatagtccttgagctgaaaggctcagagaccacctttatgtgcgagtacgcagacgaaactgctaccattgtagagttcctgaaccggtggattaccttctgtcagtccattatctctacactgaca

SEQ ID NO: 33484 - DNA, 459 bp, Artificial Sequence
  Description of Artificial Sequence: Synthetic coding sequence
atgtaccgcatgcagctgctgtcctgtatcgcgctgtccctggccctcgtcaccaattctgcccctactagctcctcgacgaagaaaacccagctccagctcgaacatctgctgctggacctgcaaatgatcctgaacggaatcaataactacaaaaatccgaagttgacccggatgcttacttttaagttctacatgccgaagaaggccaccgagcttaagcacttgcagtgcctggaggaggagctgaagccactggaagaggtgcttaatcttgcgcagagcaagaacttccatctgcgccctcgcgacctcattagcaatatcaacgtcatcgtcctggaactgaagggaagcgagactacttttatgtgcgaatacgccgatgagactgcaactatcgttgaattcctgaatcggtggatcaccttttgccagtccattatctcgaccctcact

SEQ ID NO: 33485 - DNA, 273 bp, Artificial Sequence
  Description of Artificial Sequence: Synthetic coding sequence
atgtctgctgccgacaagagggcacaccacaacgccctcgagcgcaaacgtcgggatcacatcaaggacagctttcattctcttcgcgactcggtgccaagtctgcagggggaaaaagcttccagggcccagatcctggacaaggccaccgaatacatccagtacatgagacgaaaaaaccacacacaccagcaggacatcgatgacctaaagcgccaaaacgccctacttgagcaacaagtgcgcgccctagagaaggctaggagtagtgcc

SEQ ID NO: 33486 - DNA, 273 bp, Artificial Sequence
  Description of Artificial Sequence: Synthetic coding sequence
atgtccgccgctgacaagcgcgcccatcacaatgccctcgagcgaaagcgccgagatcacatcaaagatagctttcactccctcagggactctgtccctagtttacagggcgagaaagcgtccagggctcagatcttagataaagccaccgaatatattcagtacatgaggagaaagaaccacacccaccagcaggacatcgacgacctgaaaagacagaatgcgttgctggagcagcaagtgagggctctggaaaaagctagatcctctgcc

SEQ ID NO: 33487 - DNA, 273 bp, Artificial Sequence
  Description of Artificial Sequence: Synthetic coding sequence
atgtctgccgcggataaaagggcacatcacaatgctcttgagcggaaaaggagggatcatataaaagattctttccattctctcagagattctgttccttcattacagggagagaaagcttccagagcccagatccttgacaaagcgacagaatatatccaatatatgcggcggaaaaatcacacacaccagcaggatatagatgacttaaaaagacaaaatgctcttctggagcagcaggtccgcgcacttgaaaaagctaggtcaagtgca

SEQ ID NO: 33488 - DNA, 273 bp, Artificial Sequence
  Description of Artificial Sequence: Synthetic coding sequence
atgtcagcggcagataagcgcgcacatcacaatgccctcgaaagaaagaggagggatcacatcaaagatagctttcatagcttgagggacagcgtgccaagcctgcagggcgagaaagcatcaagagctcagatcttagacaaggcgacggagtatattcaatatatgaggagaaagaaccacacgcaccaacaagatatagatgacctcaagcgtcagaatgctttgttagagcaacaggtgcgcgcactcgagaaggcaaggagtagcgcc

SEQ ID NO: 33489 - DNA, 273 bp, Artificial Sequence
  Description of Artificial Sequence: Synthetic coding sequence
atgagtgccgccgataagcgggcgcatcataatgccttggagcgcaagagacgggaccacatcaaggatagcttccattcattgcgagatagcgtcccttctctccagggcgagaaggcatcacgagcccagattctcgacaaagctaccgagtatatacagtatatgaggagaaagaaccacacacatcaacaagacatcgatgacctgaagaggcagaatgccctcctggagcagcaggtcagggctttagagaaggcgaggagcagtgcc

SEQ ID NO: 33490 - DNA, 273 bp, Artificial Sequence
  Description of Artificial Sequence: Synthetic coding sequence
atgagtgccgccgataagcgggcccaccataatgctttagaaagaaaaaggagagaccacattaaagattcgttccacagtctaagagatagtgtgcctagtttacagggagaaaaggcatctcgggctcagatactggataaagccactgaatacatccagtacatgcggcgaaaaaaccatacacaccagcaggatatcgatgatcttaaaaggcagaacgccctccttgaacagcaagtcagagcattagaaaaagcccggagttcggct

SEQ ID NO: 33491 - DNA, 273 bp, Artificial Sequence
  Description of Artificial Sequence: Synthetic coding sequence
atgtccgcagctgataagcgggcccatcacaatgccctggaaaggaaacgacgggatcacataaaagattcttttcactctttgcgcgattccgtgccttctctgcagggagaaaaagccagtcgggctcagatattagataaagctacagagtatatccagtatatgagaaggaaaaaccatacacatcagcaggacattgatgatctgaagcgacagaacgctctcctagagcagcaggtccgcgctctagaaaaagctcggtcctcagct

SEQ ID NO: 33492 - DNA, 273 bp, Artificial Sequence
  Description of Artificial Sequence: Synthetic coding sequence
atgagtgcagctgacaagagagctcatcacaacgcgttggagaggaagagacgggaccatattaaggacagctttcacagtttgcgagattctgtgccatctctccagggagagaaggccagtcgagcccaaatcctggacaaggctaccgagtatatccagtacatgagaagaaaaaaccatactcatcaacaagacatcgatgatctcaaacggcagaacgctttgctcgagcagcaggtgcgcgcactggaaaaagctcgatcctccgcc

SEQ ID NO: 33493 - DNA, 273 bp, Artificial Sequence
  Description of Artificial Sequence: Synthetic coding sequence
atgtctgctgcagataaacgagcacaccacaacgctctggaacggaaacggcgtgaccatattaaagattccttccactccctccgggatagtgttccaagtcttcagggagaaaaagccagtcgcgcccagatcctagataaagctactgagtatattcagtatatgagacgcaaaaaccatactcaccagcaggatatcgatgacctgaaacgccagaatgccctcctagaacagcaggttagagctctagaaaaagctcgatcatccgca

SEQ ID NO: 33494 - DNA, 273 bp, Artificial Sequence
  Description of Artificial Sequence: Synthetic coding sequence
atgagtgctgctgataaacgggcgcatcacaacgccctcgaacgcaaacgacgggaccatataaaggattctttccattccctccgggattcggtcccatcactgcagggagagaaagcctcaagggcccagatcctggataaagctactgaatacatacagtacatgagaaggaaaaatcacacacatcagcaggatatagatgatctgaaacggcagaacgcactgttagaacagcaggtgagggccctcgaaaaggccagatcttctgcc

SEQ ID NO: 33495 - DNA, 273 bp, Artificial Sequence
  Description of Artificial Sequence: Synthetic coding sequence
atgtccgccgctgataagcgagcgcaccacaatgcgttggagagaaaacggagagatcacattaaagatagctttcacagccttagggacagcgtgccatctcttcagggagaaaaggcatctcgagcccagatcctcgacaaagctaccgagtacatccagtacatgaggaggaagaatcacactcaccagcaagatatcgatgacctcaagaggcagaacgcattgctggagcaacaggtacgagcactcgagaaggccaggagtagcgcc

SEQ ID NO: 33496 - DNA, 273 bp, Artificial Sequence
  Description of Artificial Sequence: Synthetic coding sequence
atgtcagccgcagacaagcgcgcgcatcacaacgctctggagcgcaaacggcgcgatcacattaaggattccttccactctctgagggacagcgtgcctagtctccagggggagaaggcctcacgtgctcagatcctggataaggcaaccgaatacattcagtatatgaggcggaaaaaccatactcatcaacaggatatcgacgacttgaaacgacagaacgcccttctggagcagcaggtgcgggctcttgaaaaggctcggtccagcgct

SEQ ID NO: 33497 - DNA, 273 bp, Artificial Sequence
  Description of Artificial Sequence: Synthetic coding sequence
atgagcgctgctgacaagagagctcaccataatgcattggagcggaagcgacgcgatcatataaaagatagtttccactccctgagagattctgtccccagtctccaaggtgagaaagcctcccgggcccagatcctggataaggcgactgagtacatacaatacatgaggagaaaaaaccatactcaccagcaagacatcgacgacttgaagcggcagaatgccctgctggagcagcaagtccgcgcgctggagaaagcccggagttccgca

SEQ ID NO: 33498 - DNA, 273 bp, Artificial Sequence
  Description of Artificial Sequence: Synthetic coding sequence
atgtctgccgcagataaaagggcccaccacaatgcactagagagaaaacgccgcgatcacatcaaggactcattccacagtcttcgtgactctgttccatctcttcagggggaaaaagcgtcacgggcacagatcctcgataaagccactgaatatattcagtacatgcggcgaaaaaaccacacacaccagcaggatattgacgaccttaaacggcagaacgcccttttagaacagcaagtgcgggctctggaaaaagccagatcaagtgca

SEQ ID NO: 33499 - DNA, 273 bp, Artificial Sequence
  Description of Artificial Sequence: Synthetic coding sequence
atgagcgctgctgacaaacgagctcatcataacgcactcgaacggaaacgccgcgaccacatcaaagattcctttcattcattgcgggacagcgttccttccttgcaaggggagaaggcaagccgagcgcaaatcttggataaagcaacagagtacatccagtatatgaggagaaagaatcacacacatcaacaggacatcgacgatctgaagcgccagaatgccctcctggaacaacaagttcgggccctggagaaggcaagaagtagcgcc

SEQ ID NO: 33500 - DNA, 273 bp, Artificial Sequence
  Description of Artificial Sequence: Synthetic coding sequence
atgagtgctgctgacaagagagcccaccataacgcgctagaacgaaaaagaagggatcacataaaggacagctttcacagcctgcgcgattctgtgccaagtctgcaaggggagaaagcatccagggcacagatcctggataaggctactgaatacatacaatacatgcgacgcaaaaaccatacccaccaacaagacatcgatgatctgaagagacaaaacgccctcctggagcagcaagtccgcgccctggagaaggcgaggtctagcgcc

SEQ ID NO: 33501 - DNA, 273 bp, Artificial Sequence
  Description of Artificial Sequence: Synthetic coding sequence
atgtctgcggctgacaaacgcgcacaccataacgctctcgaacgcaagagacgcgatcatattaaggactcatttcacagtctccgggacagtgtcccatctctgcagggggagaaggctagcagggcgcaaatcctggataaggccactgaatacatccagtacatgcggcgtaaaaatcatacgcatcaacaggatatagatgatctgaaaaggcagaatgccctcctcgaacaacaggtgcgggctttagagaaagccagatcaagtgct

SEQ ID NO: 33502 - DNA, 273 bp, Artificial Sequence
  Description of Artificial Sequence: Synthetic coding sequence
atgtctgcagcagacaagcgcgctcaccataacgccctggaaagaaaaagaagggaccatataaaggattcttttcactccttgcgggattccgtcccctccctgcagggagaaaaggcctcaagagcacaaattctagataaggcaacggaatacatacaatacatgcgtaggaaaaatcatacacaccagcaggatattgacgatttgaagagacaaaacgccctccttgaacagcaggtcagggccctggaaaaggctaggagcagtgct

SEQ ID NO: 33503 - DNA, 273 bp, Artificial Sequence
  Description of Artificial Sequence: Synthetic coding sequence
atgtccgcagctgataagcgcgcccatcataatgcactggaaagaaaacgacgagatcatataaaagattcattccactctctacgagattcagtgccttccctgcagggggaaaaggcctctagggcccaaatcctcgataaggccacagaatatatacagtatatgcggaggaaaaatcacacacaccagcaggatatcgatgatctcaaaaggcagaacgctttactagagcagcaagtccgggcattagaaaaagctcggtcatccgcc

SEQ ID NO: 33504 - DNA, 273 bp, Artificial Sequence
  Description of Artificial Sequence: Synthetic coding sequence
atgagcgccgctgacaaacgggcgcatcacaacgccctcgaaaggaagcgacgtgatcacattaaagacagttttcattcgctgcgcgactctgtaccatccttgcagggcgagaaagcatcacgcgctcagatcctagacaaggctactgaatatatccagtatatgagaaggaaaaatcatacacaccagcaggatattgatgatctcaagagacaaaacgccctcctggagcaacaagtgcgcgccctggagaaggcacggtccagtgcg

SEQ ID NO: 33505 - DNA, 273 bp, Artificial Sequence
  Description of Artificial Sequence: Synthetic coding sequence
atgtcagcggccgataagcgggcccaccacaacgcactggaaaggaagcgacgggatcacatcaaggatagtttccactctttgcgagattctgtcccatctctgcaaggtgagaaggcttctagagcccagatcctcgacaaagcgacggagtacattcagtatatgcgacggaagaatcacacgcaccaacaggatatcgacgatctgaagaggcaaaatgcactgctggagcagcaggtccgtgcccttgaaaaagccagaagtagtgcg

SEQ ID NO: 33506 - DNA, 273 bp, Artificial Sequence
  Description of Artificial Sequence: Synthetic coding sequence
atgagtgctgcagacaagcgggctcaccacaacgccctggaaagaaagcgccgagaccatatcaaggacagcttccatagcctcagggattccgtacctagtttacagggggagaaggcatcccgggctcagattctagacaaggcgacggaatatattcagtatatgaggcgcaaaaaccacacacaccaacaagacatcgatgacctaaaacgtcaaaacgccctcctggagcaacaggtacgggctcttgagaaagccaggtcttcagcc

SEQ ID NO: 33507 - DNA, 273 bp, Artificial Sequence
  Description of Artificial Sequence: Synthetic coding sequence
atgtcggccgcagacaaacgggcccaccataacgctttggaaaggaaaaggcgggatcacatcaaagattccttccattccctccgcgattccgttcctagtcttcagggcgagaaggcctcccgcgcccaaattctagacaaggctaccgagtatatccagtatatgcgcaggaaaaatcacacgcaccagcaggacatcgacgaccttaagcgccaaaacgccctcctggaacagcaggtccgggcgttggagaaagcaaggtcttctgcc

SEQ ID NO: 33508 - DNA, 273 bp, Artificial Sequence
  Description of Artificial Sequence: Synthetic coding sequence
atgtctgcggcggataaacgggcccaccataacgccctggaaaggaaaaggagagaccacataaaagattcatttcattcattacgggattctgtgccaagtctgcagggagaaaaggcaagtagagcccagatacttgacaaagcaacagagtacatccaatacatgcgcaggaaaaaccacactcaccagcaggatatagacgatctaaaaaggcagaacgcgctcctcgaacaacaggtgagggccctggaaaaagcacggtcgtcagct

SEQ ID NO: 33509 - DNA, 273 bp, Artificial Sequence
  Description of Artificial Sequence: Synthetic coding sequence
atgagtgccgccgacaaacgcgcacatcataacgcactggaacgaaagcggagggatcacatcaaggacagcttccatagtctgcgcgacagtgtcccatccctccagggagagaaggcttcacgggctcagatcctggataaggccacagaatatatacaatacatgcgaagaaaaaatcatacccaccaacaggacatcgatgatctgaaaaggcagaacgccctcctcgagcagcaggtccgcgcccttgagaaggccaggtcctctgcg

SEQ ID NO: 33510 - DNA, 273 bp, Artificial Sequence
  Description of Artificial Sequence: Synthetic coding sequence
atgagcgctgccgacaagcgagcacaccacaacgccctggagcggaaaagacgggatcacattaaagacagcttccactccctccgcgattccgtcccttccctgcagggcgaaaaagccagtcgggcgcaaatcctggataaggcaaccgaatatatccagtacatgagacgaaagaatcacacacaccagcaggacatcgacgatctcaaacggcagaatgcactgcttgagcagcaagttagagccctggagaaggccagatctagtgcg

SEQ ID NO: 33511 - DNA, 273 bp, Artificial Sequence
  Description of Artificial Sequence: Synthetic coding sequence
atgagcgccgccgataaaagggcccaccacaacgccctggagaggaaaagacgggaccacatcaaggactcttttcattcactgagggactcagtgcccagcctccagggcgaaaaggcgagccgcgcacagatcctggacaaggcgactgagtatattcaatacatgagacgtaaaaaccatacccaccaacaggatatcgatgacctcaaacggcagaacgcacttcttgagcagcaggtgagggctctcgaaaaggcccgctcatctgct

SEQ ID NO: 33512 - DNA, 273 bp, Artificial Sequence
  Description of Artificial Sequence: Synthetic coding sequence
atgtccgcagcagataaaagggcacatcacaacgccctggagaggaagcggcgtgatcatatcaaagactcattccatagcctgagggatagcgtacccagcctgcaaggggaaaaggctagccgagctcaaattcttgacaaagctactgagtacattcagtacatgcgtaggaagaatcacacccatcagcaggatatagacgacctaaaaagacaaaatgctcttctcgaacagcaggtgcgcgccctggagaaggccaggtcctccgcc

SEQ ID NO: 33513 - DNA, 273 bp, Artificial Sequence
  Description of Artificial Sequence: Synthetic coding sequence
atgagtgcagctgataagcgggcccatcacaatgcgttggagcgaaaaagaagagaccacatcaaagattcatttcattcacttcgggattccgtaccctcgctgcagggagagaaagcgagccgggctcaaatcctggataaggctacagagtacattcaatatatgcgccgaaaaaatcacacacaccagcaggatattgatgacctcaaacgccagaacgcgttgttggagcagcaggtgagagctttagagaaggcccgctcctccgct

SEQ ID NO: 33514 - DNA, 273 bp, Artificial Sequence
  Description of Artificial Sequence: Synthetic coding sequence
atgagtgctgccgacaaacgtgcccaccacaacgccctggaaaggaaaaggcgtgaccacattaaagatagtttccattctttgcgggacagcgtgccctctcttcaaggcgagaaggcatcaagagctcagattctcgataaggcaactgaatacattcagtacatgaggaggaaaaaccacacacaccaacaggatatcgacgatctgaagcgtcagaacgcattgctggagcagcaggtgagagcccttgaaaaagctcgctcaagcgct

SEQ ID NO: 33515 - DNA, 273 bp, Artificial Sequence
  Description of Artificial Sequence: Synthetic coding sequence
atgagtgccgcggacaaacgtgcccaccacaatgctctagagaggaaacgtcgggatcacataaaggactccttccatagcttgcgggactcagtgccctctctccagggcgaaaaagcaagccgcgcccagatcctcgacaaagctaccgagtatatccaatatatgagacgaaaaaaccatacgcatcagcaggacatcgacgacctcaaacggcagaatgcactgctcgagcagcaggtcagggccctggaaaaggcccgatccagtgcg

SEQ ID NO: 33516 - DNA, 273 bp, Artificial Sequence
  Description of Artificial Sequence: Synthetic coding sequence
atgagcgcggcagacaaacgggcccatcataacgccttagagagaaagcgaagggaccacattaaagatagttttcacagtttgcgggacagtgttccctctttacagggcgagaaagcatctcgcgcgcagattctcgataaggccacagagtatattcagtatatgcgacggaaaaaccatactcaccagcaggacattgatgaccttaaacgtcagaatgccttgctggagcagcaagtccgagcactggagaaagcacgctcctcagct

SEQ ID NO: 33517 - DNA, 273 bp, Artificial Sequence
  Description of Artificial Sequence: Synthetic coding sequence
atgtctgccgccgacaaaagggcccaccataacgccctggaaagaaaaagaagagatcacattaaagattctttccactccctgagagattccgtgccaagtcttcagggggaaaaggcaagtcgggcacagatactggataaggccactgaatatattcagtacatgagacgcaagaatcacactcaccagcaggatatagatgacctgaaacgccaaaacgcgctcctcgagcagcaagtacgggccctggaaaaagcacgctcctctgca

SEQ ID NO: 33518 - DNA, 273 bp, Artificial Sequence
  Description of Artificial Sequence: Synthetic coding sequence
atgagcgccgccgacaaaagagcccaccacaatgctctcgagagaaagcggagagatcatatcaaagacagcttccatagtcttcgggacagcgtcccatccctccagggcgagaaagcctcacgggcacagatccttgataaggcaacagaatacatacagtacatgaggcgcaagaaccacactcaccagcaggacattgatgacctgaaacgacagaatgcgctgttggaacagcaggtgagagctttggagaaggcccggagctccgcc

SEQ ID NO: 33519 - DNA, 273 bp, Artificial Sequence
  Description of Artificial Sequence: Synthetic coding sequence
atgtccgcggcggacaaaagggcccaccacaacgcgctcgagaggaagagacgagaccacataaaggactcattccacagcctccgggattctgtacccagtctccagggggagaaggcatcccgcgctcagatcctggataaggctacagagtacatccaatatatgagaaggaaaaatcacacacaccagcaggacattgacgacctcaaacgacagaacgcgctgctcgagcaacaagtgcgggcccttgagaaagcacggagttctgcc

SEQ ID NO: 33520 - DNA, 273 bp, Artificial Sequence
  Description of Artificial Sequence: Synthetic coding sequence
atgagcgccgcagataaacgcgctcatcataacgccctcgaacggaagaggagggaccacatcaaggactcctttcactctctgcgagattcggtgcccagcctgcagggggagaaggcctcccgggcccaaattctggacaaagcgaccgaatacatacagtacatgcggcggaaaaaccacacccatcagcaagacatcgatgatctgaagaggcagaacgccttgctcgaacaacaggttagagctctcgagaaagcccgcagctctgct

SEQ ID NO: 33521 - DNA, 273 bp, Artificial Sequence
  Description of Artificial Sequence: Synthetic coding sequence
atgtctgccgccgataagagagcccaccacaatgccctagaacggaagcgcagagaccacataaaagatagcttccattcgctcagagacagcgtgccttccctgcagggtgaaaaggcgtccagggctcagattctcgataaggccaccgaatacattcagtatatgaggcggaaaaaccacacgcaccaacaggatatcgatgacctgaagcgtcagaacgcgctgttagaacagcaagtgcgcgccctggagaaggcacggtcaagcgcc

SEQ ID NO: 33522 - DNA, 273 bp, Artificial Sequence
  Description of Artificial Sequence: Synthetic coding sequence
atgagcgccgccgataaaagggcccaccacaacgccttggaaaggaaaagaagggatcacataaaggactcattccattcccttagagattcagtgccatctctgcagggcgagaaggcttccagagcccaaatcctggacaaggctacggagtatatccagtacatgcgcagaaagaaccacacccatcagcaggatattgacgatcttaagagacagaacgcacttttggagcaacaggtgcgagcgctggagaaagcgcgcagctccgcc

SEQ ID NO: 33523 - DNA, 273 bp, Artificial Sequence
  Description of Artificial Sequence: Synthetic coding sequence
atgagcgccgccgacaagcgcgctcaccacaacgcactggagaggaaaaggagggaccacatcaaagactcattccacagtctcagggactcggttcccagtctgcagggcgagaaggcgtcccgggcacagattctggataaagccactgaatacattcaatacatgcgtagaaagaaccacacccatcagcaggacattgacgacctcaaacggcagaatgccttgttagaacagcaggtgcgtgcattggagaaagcacgttcatctgca

SEQ ID NO: 33524 - DNA, 273 bp, Artificial Sequence
  Description of Artificial Sequence: Synthetic coding sequence
atgtcggcagcggacaagagggctcaccataacgcgctggaaagaaaaagaagagatcatattaaagacagcttccacagtctcagggactctgtgcccagcctacagggagagaaagcaagcagagctcagatcctcgataaagctacagaatatatccagtacatgagaaggaaaaatcacacccaccaacaggacattgacgatctcaagcgccagaacgcccttctcgagcagcaagtccgggccctcgaaaaggcccggagttccgcg

SEQ ID NO: 33525 - DNA, 273 bp, Artificial Sequence
  Description of Artificial Sequence: Synthetic coding sequence
atgagcgccgcagataagagggcccaccacaacgctctagagaggaagcgtagggaccatatcaaagatagttttcactcactccgggattcagtcccttccctgcaaggggaaaaagcctccagggcacagatactggataaagcaaccgagtatattcaatacatgcgcaggaagaaccatacccatcagcaggatattgatgacctcaagagacagaatgcccttcttgaacaacaggttcgcgctctggagaaggcgagatcaagcgcc

SEQ ID NO: 33526 - DNA, 273 bp, Artificial Sequence
  Description of Artificial Sequence: Synthetic coding sequence
atgtccgccgcagacaagagggcacatcacaacgcacttgaacgcaagaggcgcgaccatatcaaggatagctttcatagcctccgggactcagtcccgagcctccagggcgagaaagcctctcgcgcacaaattcttgacaaagctactgagtacattcagtacatgcggcgaaagaatcacacccatcagcaagacatcgacgatctgaaacgtcagaacgccctgctcgaacagcaggtcagggcattggaaaaagctcggtccagcgca

SEQ ID NO: 33527 - DNA, 273 bp, Artificial Sequence
  Description of Artificial Sequence: Synthetic coding sequence
atgtccgccgccgataagagggcccatcacaatgccttggagagaaaacggcgggatcatattaaagattctttccatagcttgcgcgatagcgtaccgtctctccagggggagaaggcaagccgggcacagatattggataaggcgactgagtatattcaatacatgcgacggaagaatcatacacatcaacaggacatcgacgatctcaaacggcagaacgccctgcttgagcagcaggttcgcgctctcgagaaagcgcggtccagtgcc

SEQ ID NO: 33528 - DNA, 273 bp, Artificial Sequence
  Description of Artificial Sequence: Synthetic coding sequence
atgtccgccgccgacaaacgcgcacatcacaacgcccttgagaggaagagaagagaccatattaaagattcgttccacagcttgagggacagcgtcccttccctccaaggcgagaaggccagcagagctcagatactcgacaaggccacagagtacatacagtacatgagaagaaaaaaccacacacaccaacaggacattgatgatctgaaacgccagaatgcactgctggaacagcaggtgcgggccttggaaaaggcaaggagctccgct

SEQ ID NO: 33529 - DNA, 273 bp, Artificial Sequence
  Description of Artificial Sequence: Synthetic coding sequence
atgagcgccgctgataagcgcgctcatcataatgcgctcgagaggaaaagaagggaccacattaaagattcttttcacagtctgcgcgactccgttccatccctgcagggagagaaggccagcagagcccaaatactggacaaagccaccgagtatatacagtacatgcggaggaagaaccatacccatcagcaggatatagatgatctgaagaggcagaacgccctgttggagcagcaggtacgcgctttggagaaggcaagatcatcagcc

SEQ ID NO: 33530 - DNA, 273 bp, Artificial Sequence
  Description of Artificial Sequence: Synthetic coding sequence
atgagcgctgctgacaagcgcgcccatcataacgctctagaaaggaaaaggcgggatcatattaaagacagtttccactcacttagagactctgtccctagcctgcaaggggagaaagctagccgagctcaaatccttgacaaagcgaccgagtatatccagtacatgcgacgtaagaatcacacacatcaacaggatattgatgacctaaagcgacagaacgcactgttggaacaacaggttagagcactcgagaaggctaggtcttccgct

SEQ ID NO: 33531 - DNA, 273 bp, Artificial Sequence
  Description of Artificial Sequence: Synthetic coding sequence
atgagcgccgccgacaagagagcccaccataacgctctggaacgaaagcgccgagatcatatcaaagattcattccactctttgcgggattcagtgccctctctccagggcgaaaaggcaagccgggcgcagatcctggacaaggccaccgaatatatacagtatatgaggcgcaaaaatcacactcatcaacaagatatagatgatttgaaacgacaaaacgcgctgcttgagcagcaggtgagagccttggagaaagcacgcagtagcgcc

SEQ ID NO: 33532 - DNA, 273 bp, Artificial Sequence
  Description of Artificial Sequence: Synthetic coding sequence
atgtcggctgctgacaagagggcacatcataacgctttggagaggaagagacgcgatcacatcaaagatagcttccactcattgagggattcggtcccaagtctgcagggagagaaggcctcacgtgcccaaatcctggataaggccactgagtatattcagtacatgcgcagaaagaatcatactcaccagcaggatatagacgacctgaagcggcaaaatgctctcctggagcagcaagtgagggcccttgagaaagctagatcttctgcc

SEQ ID NO: 33533 - DNA, 273 bp, Artificial Sequence
  Description of Artificial Sequence: Synthetic coding sequence
atgagcgctgccgataagcgtgcccaccataacgctctggaacggaaaaggcgcgatcacataaaggacagcttccatagcctgagagacagtgtcccatcgcttcaaggggaaaaggcctcacgagctcaaattctggataaagccacggagtacattcagtatatgcggcggaaaaatcatacacatcaacaggatatcgacgacctgaaacggcagaacgcgctccttgagcagcaggtccgcgccctcgaaaaagctcgctcctctgcg

SEQ ID NO: 33534 - DNA, 273 bp, Artificial Sequence
  Description of Artificial Sequence: Synthetic coding sequence
atgtcagccgccgataaacgtgctcatcataacgctcttgaaagaaagagacgcgatcatattaaagattctttccactcccttagagattctgtgccctctctgcagggggaaaaagcaagtagagctcagatactagataaagctacagaatatatccagtacatgcggagaaaaaatcatactcaccagcaagatatagatgatctaaaaagacagaatgcattgctggaacagcaggtaagagccctggagaaagcaaggtcctcagcg

SEQ ID NO: 33535 - DNA, 1434 bp, Artificial Sequence; identical to SEQ ID NO: 32528
  Description of Artificial Sequence: Synthetic coding sequence

SEQ ID NO: 33536 - DNA, 1434 bp, Artificial Sequence; identical to SEQ ID NO: 32529
  Description of Artificial Sequence: Synthetic coding sequence

SEQ ID NO: 33537 - DNA, 1434 bp, Artificial Sequence; identical to SEQ ID NO: 32530
  Description of Artificial Sequence: Synthetic coding sequence

SEQ ID NO: 33538 - DNA, 1434 bp, Artificial Sequence; identical to SEQ ID NO: 32531
  Description of Artificial Sequence: Synthetic coding sequence

SEQ ID NO: 33539 - DNA, 1434 bp, Artificial Sequence; identical to SEQ ID NO: 32532
  Description of Artificial Sequence: Synthetic coding sequence

SEQ ID NO: 33540 - DNA, 1434 bp, Artificial Sequence; identical to SEQ ID NO: 32533
  Description of Artificial Sequence: Synthetic coding sequence

SEQ ID NO: 33541 - DNA, 1434 bp, Artificial Sequence; identical to SEQ ID NO: 32534
  Description of Artificial Sequence: Synthetic coding sequence

SEQ ID NO: 33542 - DNA, 1434 bp, Artificial Sequence; identical to SEQ ID NO: 32535
  Description of Artificial Sequence: Synthetic coding sequence

SEQ ID NO: 33543 - DNA, 1434 bp, Artificial Sequence; identical to SEQ ID NO: 32536
  Description of Artificial Sequence: Synthetic coding sequence

SEQ ID NO: 33544 - DNA, 1434 bp, Artificial Sequence; identical to SEQ ID NO: 32537
  Description of Artificial Sequence: Synthetic coding sequence

SEQ ID NO: 33545 - DNA, 1434 bp, Artificial Sequence; identical to SEQ ID NO: 32538
  Description of Artificial Sequence: Synthetic coding sequence

SEQ ID NO: 33546 - DNA, 1434 bp, Artificial Sequence; identical to SEQ ID NO: 32539
  Description of Artificial Sequence: Synthetic coding sequence

SEQ ID NO: 33547 - DNA, 1434 bp, Artificial Sequence; identical to SEQ ID NO: 32540
  Description of Artificial Sequence: Synthetic coding sequence

SEQ ID NO: 33548 - DNA, 1434 bp, Artificial Sequence; identical to SEQ ID NO: 32541
  Description of Artificial Sequence: Synthetic coding sequence

SEQ ID NO: 33549 - DNA, 1434 bp, Artificial Sequence; identical to SEQ ID NO: 32542
  Description of Artificial Sequence: Synthetic coding sequence

SEQ ID NO: 33550 - DNA, 1434 bp, Artificial Sequence; identical to SEQ ID NO: 32543
  Description of Artificial Sequence: Synthetic coding sequence

SEQ ID NO: 33551 - DNA, 1434 bp, Artificial Sequence; identical to SEQ ID NO: 32544
  Description of Artificial Sequence: Synthetic coding sequence

SEQ ID NO: 33552 - DNA, 1434 bp, Artificial Sequence; identical to SEQ ID NO: 32545
  Description of Artificial Sequence: Synthetic coding sequence

SEQ ID NO: 33553 - DNA, 1434 bp, Artificial Sequence; identical to SEQ ID NO: 32546
  Description of Artificial Sequence: Synthetic coding sequence

SEQ ID NO: 33554 - DNA, 1434 bp, Artificial Sequence; identical to SEQ ID NO: 32547
  Description of Artificial Sequence: Synthetic coding sequence

SEQ ID NO: 33555 - DNA, 1434 bp, Artificial Sequence; identical to SEQ ID NO: 32548
  Description of Artificial Sequence: Synthetic coding sequence

SEQ ID NO: 33556 - DNA, 1434 bp, Artificial Sequence; identical to SEQ ID NO: 32549
  Description of Artificial Sequence: Synthetic coding sequence

SEQ ID NO: 33557 - DNA, 1434 bp, Artificial Sequence; identical to SEQ ID NO: 32550
  Description of Artificial Sequence: Synthetic coding sequence

SEQ ID NO: 33558 - DNA, 1434 bp, Artificial Sequence; identical to SEQ ID NO: 32551
  Description of Artificial Sequence: Synthetic coding sequence

SEQ ID NO: 33559 - DNA, 1434 bp, Artificial Sequence; identical to SEQ ID NO: 32552
  Description of Artificial Sequence: Synthetic coding sequence

SEQ ID NO: 33560 - DNA, 1434 bp, Artificial Sequence; identical to SEQ ID NO: 32553
  Description of Artificial Sequence: Synthetic coding sequence

SEQ ID NO: 33561 - DNA, 1434 bp, Artificial Sequence; identical to SEQ ID NO: 32554
  Description of Artificial Sequence: Synthetic coding sequence

SEQ ID NO: 33562 - DNA, 1434 bp, Artificial Sequence; identical to SEQ ID NO: 32555
  Description of Artificial Sequence: Synthetic coding sequence

SEQ ID NO: 33563 - DNA, 1434 bp, Artificial Sequence; identical to SEQ ID NO: 32556
  Description of Artificial Sequence: Synthetic coding sequence

SEQ ID NO: 33564 - DNA, 1434 bp, Artificial Sequence; identical to SEQ ID NO: 32557
  Description of Artificial Sequence: Synthetic coding sequence

SEQ ID NO: 33565 - DNA, 1434 bp, Artificial Sequence; identical to SEQ ID NO: 32558
  Description of Artificial Sequence: Synthetic coding sequence

SEQ ID NO: 33566 - DNA, 1434 bp, Artificial Sequence; identical to SEQ ID NO: 32559
  Description of Artificial Sequence: Synthetic coding sequence

SEQ ID NO: 33567 - DNA, 1434 bp, Artificial Sequence; identical to SEQ ID NO: 32560
  Description of Artificial Sequence: Synthetic coding sequence

SEQ ID NO: 33568 - DNA, 1434 bp, Artificial Sequence; identical to SEQ ID NO: 32561
  Description of Artificial Sequence: Synthetic coding sequence

SEQ ID NO: 33569 - DNA, 1434 bp, Artificial Sequence; identical to SEQ ID NO: 32562
  Description of Artificial Sequence: Synthetic coding sequence

SEQ ID NO: 33570 - DNA, 1434 bp, Artificial Sequence; identical to SEQ ID NO: 32563
  Description of Artificial Sequence: Synthetic coding sequence

SEQ ID NO: 33571 - DNA, 1434 bp, Artificial Sequence; identical to SEQ ID NO: 32564
  Description of Artificial Sequence: Synthetic coding sequence

SEQ ID NO: 33572 - DNA, 1434 bp, Artificial Sequence; identical to SEQ ID NO: 32565
  Description of Artificial Sequence: Synthetic coding sequence

SEQ ID NO: 33573 - DNA, 1434 bp, Artificial Sequence; identical to SEQ ID NO: 32566
  Description of Artificial Sequence: Synthetic coding sequence

SEQ ID NO: 33574 - DNA, 1434 bp, Artificial Sequence; identical to SEQ ID NO: 32567
  Description of Artificial Sequence: Synthetic coding sequence

SEQ ID NO: 33575 - DNA, 1434 bp, Artificial Sequence; identical to SEQ ID NO: 32568
  Description of Artificial Sequence: Synthetic coding sequence

SEQ ID NO: 33576 - DNA, 1434 bp, Artificial Sequence; identical to SEQ ID NO: 32569
  Description of Artificial Sequence: Synthetic coding sequence

SEQ ID NO: 33577 - DNA, 1434 bp, Artificial Sequence; identical to SEQ ID NO: 32570
  Description of Artificial Sequence: Synthetic coding sequence

SEQ ID NO: 33578 - DNA, 1434 bp, Artificial Sequence; identical to SEQ ID NO: 32571
  Description of Artificial Sequence: Synthetic coding sequence

SEQ ID NO: 33579 - DNA, 1434 bp, Artificial Sequence; identical to SEQ ID NO: 32572
  Description of Artificial Sequence: Synthetic coding sequence

SEQ ID NO: 33580 - DNA, 1434 bp, Artificial Sequence; identical to SEQ ID NO: 32573
  Description of Artificial Sequence: Synthetic coding sequence

SEQ ID NO: 33581 - DNA, 1434 bp, Artificial Sequence; identical to SEQ ID NO: 32574
  Description of Artificial Sequence: Synthetic coding sequence

SEQ ID NO: 33582 - DNA, 1434 bp, Artificial Sequence; identical to SEQ ID NO: 32575
  Description of Artificial Sequence: Synthetic coding sequence

SEQ ID NO: 33583 - DNA, 1434 bp, Artificial Sequence; identical to SEQ ID NO: 32576
  Description of Artificial Sequence: Synthetic coding sequence

SEQ ID NO: 33584 - DNA, 1434 bp, Artificial Sequence; identical to SEQ ID NO: 32577
  Description of Artificial Sequence: Synthetic coding sequence

SEQ ID NO: 33585 - DNA, 1434 bp, Artificial Sequence; identical to SEQ ID NO: 32578
  Description of Artificial Sequence: Synthetic coding sequence

SEQ ID NO: 33586 - DNA, 1434 bp, Artificial Sequence; identical to SEQ ID NO: 32579
  Description of Artificial Sequence: Synthetic coding sequence

SEQ ID NO: 33587 - DNA, 1434 bp, Artificial Sequence; identical to SEQ ID NO: 32580
  Description of Artificial Sequence: Synthetic coding sequence

SEQ ID NO: 33588 - DNA, 1434 bp, Artificial Sequence; identical to SEQ ID NO: 32581
  Description of Artificial Sequence: Synthetic coding sequence

SEQ ID NO: 33589 - DNA, 1434 bp, Artificial Sequence; identical to SEQ ID NO: 32582
  Description of Artificial Sequence: Synthetic coding sequence

SEQ ID NO: 33590 - DNA, 1434 bp, Artificial Sequence; identical to SEQ ID NO: 32583
  Description of Artificial Sequence: Synthetic coding sequence

SEQ ID NO: 33591 - DNA, 1434 bp, Artificial Sequence; identical to SEQ ID NO: 32584
  Description of Artificial Sequence: Synthetic coding sequence

SEQ ID NO: 33592 - DNA, 1434 bp, Artificial Sequence; identical to SEQ ID NO: 32585
  Description of Artificial Sequence: Synthetic coding sequence

SEQ ID NO: 33593 - DNA, 1434 bp, Artificial Sequence; identical to SEQ ID NO: 32586
  Description of Artificial Sequence: Synthetic coding sequence

SEQ ID NO: 33594 - DNA, 1434 bp, Artificial Sequence; identical to SEQ ID NO: 32587
  Description of Artificial Sequence: Synthetic coding sequence

SEQ ID NO: 33595 - DNA, 1434 bp, Artificial Sequence; identical to SEQ ID NO: 32588
  Description of Artificial Sequence: Synthetic coding sequence

SEQ ID NO: 33596 - DNA, 1434 bp, Artificial Sequence; identical to SEQ ID NO: 32589
  Description of Artificial Sequence: Synthetic coding sequence

SEQ ID NO: 33597 - DNA, 1434 bp, Artificial Sequence; identical to SEQ ID NO: 32590
  Description of Artificial Sequence: Synthetic coding sequence

SEQ ID NO: 33598 - DNA, 1434 bp, Artificial Sequence; identical to SEQ ID NO: 32591
  Description of Artificial Sequence: Synthetic coding sequence

SEQ ID NO: 33599 - DNA, 1434 bp, Artificial Sequence; identical to SEQ ID NO: 32592
  Description of Artificial Sequence: Synthetic coding sequence

SEQ ID NO: 33600 - DNA, 1434 bp, Artificial Sequence; identical to SEQ ID NO: 32593
  Description of Artificial Sequence: Synthetic coding sequence

SEQ ID NO: 33601 - DNA, 1434 bp, Artificial Sequence; identical to SEQ ID NO: 32594
  Description of Artificial Sequence: Synthetic coding sequence

SEQ ID NO: 33602 - DNA, 1434 bp, Artificial Sequence; identical to SEQ ID NO: 32595
  Description of Artificial Sequence: Synthetic coding sequence

SEQ ID NO: 33603 - DNA, 1434 bp, Artificial Sequence; identical to SEQ ID NO: 32596
  Description of Artificial Sequence: Synthetic coding sequence

SEQ ID NO: 33604 - DNA, 1434 bp, Artificial Sequence; identical to SEQ ID NO: 32597
  Description of Artificial Sequence: Synthetic coding sequence

SEQ ID NO: 33605 - DNA, 1434 bp, Artificial Sequence; identical to SEQ ID NO: 32598
  Description of Artificial Sequence: Synthetic coding sequence

SEQ ID NO: 33606 - DNA, 1434 bp, Artificial Sequence; identical to SEQ ID NO: 32599
  Description of Artificial Sequence: Synthetic coding sequence

SEQ ID NO: 33607 - DNA, 1434 bp, Artificial Sequence; identical to SEQ ID NO: 32600
  Description of Artificial Sequence: Synthetic coding sequence

SEQ ID NO: 33608 - DNA, 1434 bp, Artificial Sequence; identical to SEQ ID NO: 32601
  Description of Artificial Sequence: Synthetic coding sequence

SEQ ID NO: 33609 - DNA, 1434 bp, Artificial Sequence; identical to SEQ ID NO: 32602
  Description of Artificial Sequence: Synthetic coding sequence

SEQ ID NO: 33610 - DNA, 1434 bp, Artificial Sequence; identical to SEQ ID NO: 32603
  Description of Artificial Sequence: Synthetic coding sequence

SEQ ID NO: 33611 - DNA, 1434 bp, Artificial Sequence; identical to SEQ ID NO: 32604
  Description of Artificial Sequence: Synthetic coding sequence

SEQ ID NO: 33612 - DNA, 1434 bp, Artificial Sequence; identical to SEQ ID NO: 32605
  Description of Artificial Sequence: Synthetic coding sequence

SEQ ID NO: 33613 - DNA, 1434 bp, Artificial Sequence; identical to SEQ ID NO: 32606
  Description of Artificial Sequence: Synthetic coding sequence

SEQ ID NO: 33614 - DNA, 1434 bp, Artificial Sequence; identical to SEQ ID NO: 32607
  Description of Artificial Sequence: Synthetic coding sequence

SEQ ID NO: 33615 - DNA, 1434 bp, Artificial Sequence; identical to SEQ ID NO: 32599
  Description of Artificial Sequence: Synthetic coding sequence

SEQ ID NO: 33616 - DNA, 1434 bp, Artificial Sequence; identical to SEQ ID NO: 32609
  Description of Artificial Sequence: Synthetic coding sequence

SEQ ID NO: 33617 - DNA, 1434 bp, Artificial Sequence; identical to SEQ ID NO: 32610
  Description of Artificial Sequence: Synthetic coding sequence

SEQ ID NO: 33618 - DNA, 1434 bp, Artificial Sequence; identical to SEQ ID NO: 32611
  Description of Artificial Sequence: Synthetic coding sequence

SEQ ID NO: 33619 - DNA, 1434 bp, Artificial Sequence; identical to SEQ ID NO: 32612
  Description of Artificial Sequence: Synthetic coding sequence

SEQ ID NO: 33620 - DNA, 1434 bp, Artificial Sequence; identical to SEQ ID NO: 32613
  Description of Artificial Sequence: Synthetic coding sequence

SEQ ID NO: 33621 - DNA, 1434 bp, Artificial Sequence; identical to SEQ ID NO: 32614
  Description of Artificial Sequence: Synthetic coding sequence

SEQ ID NO: 33622 - DNA, 846 bp, Artificial Sequence
  Description of Artificial Sequence: Synthetic coding sequence
atgtcgagacagaccgcaactgccctgccgactggcacctcgaagtgcccgccgtcgcagagggtccccgccctgaccggcaccaccgcatcgaacaacgatctggcatccctcttcgaatgccccgtctgtttcgactacgttctgccccctatcctccagtgccagtcaggacacctcgtctgctcaaattgccggcctaagctcacttgctgccctacctgccggggacccctgggatccatccgcaatctggcgatggaaaaggtagcaaactctgtgctgttcccgtgcaagtacgcaagctccggatgcgagatcacgttgccgcatactgagaaggcggaccacgaggagttgtgcgaatttcgcccgtactcttgcccgtgtcctggcgcttcgtgtaaatggcagggatctttggacgccgtgatgcctcacctcatgcatcaacataaatccatcaccactctgcaaggagaggacatcgtgttcctggcaaccgatatcaatttgccaggagcggtggactgggtgatgatgcaatcatgtttcggttttcacttcatgttggtgctcgaaaagcaagagaagtacgacggtcatcagcagtttttcgccatagtgcaactgatcggcactcgtaaacaggccgagaacttcgcctatcggctggaactgaacggccaccgcaggcggcttacgtgggaagcgaccccgagatcaatccacgaaggaatcgccaccgccattatgaacagcgattgtttggttttcgacactagcatcgctcaactgttcgccgaaaatggaaacctggggattaatgtgacgatctccatgtgc

SEQ ID NO: 33623 - DNA, 846 bp, Artificial Sequence
  Description of Artificial Sequence: Synthetic coding sequence
atgagtcgccagaccgcaaccgccctcccgaccggaacatctaagtgccctccctcccaacgcgtgcctgcgctcactggcaccacagctagcaataatgacctggcctcactgttcgaatgccccgtgtgcttcgattatgtgctgccacccatcctccagtgccagagtgggcatctggtttgctcgaactgtaggccgaaactgacttgctgtcccacctgccgcggcccactcggcagcattaggaacctggctatggaaaaagtcgctaattctgttctgtttccctgcaaatatgcaagcagtggttgtgaaatcacattaccacacaccgagaaagcggaccacgaagagttgtgcgaatttcgaccttacagttgtccgtgtcctggcgcaagttgtaagtggcagggatctctcgacgccgtgatgccacacctgatgcaccagcataaatctattacgacccttcagggtgaggacatcgtgttcctagcgacggatatcaacctgcccggagccgtagattgggtgatgatgcagtcctgctttgggttccacttcatgttggtcctggagaaacaggaaaagtacgacggtcaccagcagtttttcgccatcgtacagcttattggcaccagaaagcaggccgagaacttcgcatacaggttggaactcaatgggcacaggcggagactgacctgggaagcgaccccccggtccatccatgaggggattgccacagccattatgaactctgactgcttggtgttcgacacatcaattgcccagctgttcgccgaaaacggcaatctcggcatcaatgttaccatctcaatgtgc

SEQ ID NO: 33624 - DNA, 846 bp, Artificial Sequence
  Description of Artificial Sequence: Synthetic coding sequence
atgtctcggcagacggccaccgcactgcccactggtacatccaagtgtcctccctcccagcgggtacctgctctgaccggaaccaccgcaagtaataacgatcttgcttcgctgtttgagtgccccgtttgcttcgattatgtgctgcccccgatactgcaatgtcagtccggacatctggtatgcagcaattgccgccccaagctaacatgttgcccaacctgcagaggccccctcggatccattaggaatttagccatggaaaaagtcgccaattctgtactgtttccctgcaagtacgcatcaagtgggtgcgagattacactgcctcatacagagaaggccgaccacgaggagttgtgtgaattccgtccttactcctgcccatgtccgggtgcgagttgcaagtggcagggatctctcgacgcggtgatgcctcatttaatgcaccagcataagagtataactactttacagggggaagacattgtcttcttggcaacagacatcaacttgccgggggccgtcgattgggttatgatgcagagctgctttggcttccacttcatgctagtgctggagaagcaggaaaaatacgacgggcaccaacagttcttcgcaattgtgcagctgatcggcacccgaaaacaggccgagaactttgcttaccgtctagagttgaacggacaccgacgcaggctgacttgggaggccacccctcgctccattcatgaaggaatcgcaacggctatcatgaactcggattgcctggttttcgatacgtcaatagcacaactgttcgccgaaaatgggaacctgggtataaacgttactatatcaatgtgc

SEQ ID NO: 33625 - DNA, 846 bp, Artificial Sequence
  Description of Artificial Sequence: Synthetic coding sequence
atgtcacggcagactgccaccgcactgcccactggcacgtccaagtgcccgccttcgcagcgcgtgcctgcactgactggtaccactgcctcgaataatgacctggcaagcctgtttgaatgcccagtgtgtttcgactacgtgctcccgcccatcctgcagtgccagtcggggcatctggtctgctcgaattgccggcctaaactgacctgttgcccgacctgcagaggccccctcggatccatccgaaacctcgcaatggaaaaggtcgcgaattcggttctcttcccatgcaaatacgcatcttccgggtgcgagatcactctgccccacaccgagaaagcagaccacgaggaactgtgcgagtttcggccgtactcgtgcccgtgccctggggcctcttgtaagtggcagggttcgctcgacgccgtcatgccgcacctcatgcatcaacacaagagcatcactacgctgcagggcgaagatattgtctttctcgccactgatatcaacctgccgggtgctgtcgactgggtcatgatgcaatcctgtttcggattccacttcatgttggtgctcgagaagcaggaaaagtacgatgggcatcagcagttcttcgccatcgtgcagctgatcggcactagaaaacaagccgaaaacttcgcctacaggctcgagctcaatggtcaccggcgccggctgacttgggaagcgaccccaaggtcgatccacgagggaatcgccactgctatcatgaattcggactgccttgtgttcgacacttcaatcgcgcaactgttcgcggaaaacggaaacctgggaatcaatgtgaccatctcgatgtgc

SEQ ID NO: 33626 - DNA, 846 bp, Artificial Sequence
  Description of Artificial Sequence: Synthetic coding sequence
atgagccgccagaccgcgaccgctctgcctactggtacttcgaagtgccctccgtctcaacgtgtccccgccctgaccggaaccactgccagcaacaatgatctcgcctcccttttcgaatgcccagtctgttttgactacgtcctcccgccgatcctgcagtgtcagagcggacatctcgtgtgttcaaattgccggccaaaactcacttgctgccctacttgccgcggaccgttgggtagcatcagaaatctggcaatggaaaaagtcgccaactcggttctcttcccatgcaaatacgcttcatcaggatgcgaaatcacccttccgcacactgagaaggctgaccacgaagaactctgcgagttccggccatactcttgcccttgcccaggtgcctcctgcaagtggcaaggatcactggatgcggtgatgccgcatctcatgcaccagcataaatcgattactactcttcagggagaggacatcgtgtttctcgccaccgacatcaacctgccgggtgccgtggattgggtgatgatgcaatcatgtttcggatttcacttcatgttggtgctcgagaagcaagaaaagtacgacgggcatcagcagttctttgctatcgtgcagctgattggaactaggaagcaagcggagaacttcgcataccggctcgagctgaacggtcatcgcaggaggctcacttgggaagcaactccgcggtcaatccacgagggaatcgccactgccatcatgaactcggattgcctggtgtttgacaccagcatcgctcaattgttcgccgaaaacggcaaccttgggatcaacgtgactatctcgatgtgc

SEQ ID NO: 33627 - DNA, 846 bp, Artificial Sequence
  Description of Artificial Sequence: Synthetic coding sequence
atgagccggcagaccgcaaccgccctgccgacgggaacttcaaagtgcccgccgagccagcgcgtgcccgcgctgactggaactactgcatcgaataatgacttggcttccctgttcgaatgcccggtgtgcttcgattacgtgctgcctcccatcttgcaatgtcagagcggtcacctcgtatgttccaactgcagacctaaactgacttgctgcccgacttgccggggtccactgggatccatccgaaacctcgctatggagaaagttgctaactcagtgctgttcccttgtaagtacgccagtagcgggtgcgaaatcaccctcccccacactgagaaagcggatcatgaagagctgtgtgagttccggccgtattcatgtccttgcccgggtgcctcatgcaagtggcaaggttcgctggacgccgtgatgccacacctgatgcaccagcataaatcgatcaccaccctccaaggagaagacattgttttcctcgcaactgacatcaacctgccaggagccgtggattgggtcatgatgcagtcttgcttcggcttccatttcatgctggtccttgaaaagcaggagaagtacgacggacaccaacagttctttgccatcgtgcagctgatcggcaccagaaagcaggcagagaatttcgcctaccgcctcgaacttaatgggcaccggcgaagactgacctgggaagcaacccctcgatccattcatgagggaatagctacggcaattatgaactcggattgcctcgtgtttgacactagcatcgctcaattgtttgccgaaaacggaaatcttgggattaacgtcacgatcagcatgtgc

SEQ ID NO: 33628 - DNA, 846 bp, Artificial Sequence
  Description of Artificial Sequence: Synthetic coding sequence
atgtcgcgccaaacagctaccgccctgcctacggggacctctaagtgccccccaagccagcgagtccctgcgctgacgggcactaccgccagcaacaatgatctcgcaagcctcttcgagtgccctgtgtgtttcgactatgtactgccccctatcctgcagtgccagtccggtcatttggtgtgtagcaactgtcggcctaagctgacctgctgccccacgtgtaggggacctcttggctcgatccgaaacctggctatggaaaaagtcgccaactccgtgctgttcccctgtaagtacgcctcttcaggatgtgagatcactctccctcacaccgaaaaagccgaccatgaagagttatgtgaatttagaccctactcctgtccttgtcctggggccagttgcaagtggcaggggagtctggacgccgttatgccccacctgatgcatcagcataagagtatcactaccctgcaaggcgaagacattgtgttcctagcaactgatattaacttgcctggggctgtcgactgggtcatgatgcagtcttgtttcgggtttcacttcatgctggtactggagaaacaagagaaatacgatggccaccagcagttctttgctatcgtgcagctgatcggaactagaaagcaggccgagaacttcgcttatcgcttagaactcaatggtcacagaagacggctgacctgggaggcgaccccccgcagcatccacgaaggaatcgccactgccataatgaattctgactgcttagttttcgacacatctatcgcccagcttttcgctgaaaatggcaatttggggattaatgtcaccatcagtatgtgc

SEQ ID NO: 33629 - DNA, 846 bp, Artificial Sequence
  Description of Artificial Sequence: Synthetic coding sequence
atgtcgcggcagactgctacggctctgcctaccggaacgtcgaaatgcccaccgtcccaaagggtgcctgccctgaccggcactacggcgtccaataatgaccttgcaagcctgttcgaatgtccggtttgcttcgactacgtcctcccacctatcttgcagtgccagtcaggtcacctcgtttgttccaattgtcgcccaaaactgacttgctgcccaacttgtcggggaccgctgggaagcatcagaaatttggctatggagaaggtcgctaactccgtgctcttcccctgtaagtatgcctcatcaggatgtgaaattactctgccgcataccgagaaagcggaccacgaagagctctgcgagtttcgcccatactcctgcccgtgccctggagcctcctgtaagtggcagggatcactggatgccgtgatgccgcacctgatgcatcaacataaatcgattaccaccctccagggagaggacatcgtgttcctggcgactgacatcaatctgccgggagcggtggactgggttatgatgcaatcatgcttcggattccatttcatgctggtgcttgaaaagcaagaaaagtacgatggacaccagcagttcttcgctattgtccagctgatcggaactcgcaagcaggcggagaacttcgcttacagactggaactgaacggacacagacgccggctcacctgggaagccactccgcggtctatccacgagggaatcgcaaccgcaatcatgaattccgactgcctggtctttgatactagcatcgcgcagctgttcgctgaaaacggaaacttgggaataaacgtgaccatctctatgtgc

SEQ ID NO: 33630 - DNA, 846 bp, Artificial Sequence
  Description of Artificial Sequence: Synthetic coding sequence
atgtcaagacaaaccgcgactgctctgccaactgggacctcgaagtgcccaccttcgcagcgcgtccctgcactgactggtactaccgcatcaaacaatgatctcgcatctctgttcgagtgtcctgtgtgttttgattacgtgcttcctcctatcctgcagtgtcagtcaggtcaccttgtctgtagcaattgtcgaccaaaattgacctgttgtccaacctgtagaggcccactcggttcaattaggaatctcgcaatggaaaaggtggcaaacagcgtcctctttccttgtaaatacgcatcgtcgggatgtgaaatcacgctccctcatactgagaaagcagatcacgaagagctgtgcgaatttcggccctactcgtgcccttgtccgggtgcttcctgtaagtggcagggttcactggacgcagtaatgccccatctgatgcaccaacataaaagcattaccactcttcaaggagaggacattgtgtttcttgcaacggacattaaccttccaggagcggtggactgggtgatgatgcaatcgtgtttcggatttcatttcatgttggtgcttgaaaagcaggagaagtacgatggccaccaacagtttttcgcgattgttcagctgattggaacgcggaagcaggcagagaatttcgcctaccgacttgaacttaatggtcataggcgccggctgacctgggaagcaaccccacgaagcatccatgagggaatcgcgaccgcaattatgaactccgattgtctcgtctttgatacgtccattgcccaattgtttgcggaaaacggcaacctgggcattaatgtaaccatctccatgtgt

SEQ ID NO: 33631 - DNA, 846 bp, Artificial Sequence
  Description of Artificial Sequence: Synthetic coding sequence
atgagccgccagacggcgactgctctcccaacgggaactagcaaatgtcctccctctcaacgcgtgccagcacttaccggtaccactgcgtcaaacaatgacttggcgagcctcttcgaatgtcctgtctgcttcgactatgtgctcccccctatccttcagtgtcaatcgggtcatctcgtttgttcgaactgccggcctaagctgacttgctgtcctacctgcagaggacctttgggctcaattagaaatttggcaatggaaaaagtcgcaaactccgtgttgtttccatgcaagtacgcatcatccggttgtgaaattaccctgccacacacggaaaaggccgatcacgaagaactgtgcgaattccgcccttactcctgtccatgccctggagcaagctgcaagtggcaaggatcgttggatgcagttatgccacaccttatgcaccagcacaagtcgataactactctccagggggaagatatagtgttcctggcaacggatatcaacctcccaggggcagtcgactgggtcatgatgcagtcgtgttttgggtttcacttcatgctggtgctcgaaaagcaggaaaagtacgatggccatcagcagttctttgctattgtgcaacttattggaaccagaaagcaagccgagaactttgcataccgactggagctgaatggacatcgcaggcgtttgacttgggaagcgaccccccggtcgatccatgaggggatcgccactgcaattatgaattccgattgtctcgtctttgacacttcgattgcacaattgtttgccgaaaacggcaaccttggaatcaacgtgactatttcgatgtgt

SEQ ID NO: 33632 - DNA, 846 bp, Artificial Sequence
  Description of Artificial Sequence: Synthetic coding sequence
atgtctcggcagacggcgactgcactccctacaggcacatccaagtgccccccttcacagagagtgcctgcccttactggaaccacggccagcaataacgaccttgcttcccttttcgaatgcccagtctgctttgactacgtgttgcctcctatcctgcagtgccaatcagggcatctggtgtgttctaattgtaggcctaaacttacatgctgcccaacgtgccgcggtccactgggttcaatccggaacctcgccatggaaaaggtggctaatagtgtgctgtttccatgcaagtatgcctctagcggatgtgagatcacactcccccacactgaaaaagccgatcacgaagaactctgtgaatttaggccttatagttgtccctgtcccggcgcatcctgtaagtggcagggcagtcttgacgctgtgatgccacacctgatgcaccagcacaagtccataacaaccctgcagggagaggacatcgtcttcctcgcgaccgacataaacttgcccggtgcagttgactgggtgatgatgcagtcatgtttcggtttccacttcatgctcgttcttgagaaacaggagaaatacgatggacatcagcagtttttcgccattgttcagctcatcggtactcggaagcaggccgagaactttgcgtaccgcttggagctcaacgggcaccgcagacggctcacttgggaagcgacccctagatccattcacgaaggcatcgcgacagctattatgaactctgactgcttggtgtttgacacatcaattgcccaactctttgcggaaaacggaaatctggggatcaacgttacgattagtatgtgt

SEQ ID NO: 33633 - DNA, 846 bp, Artificial Sequence
  Description of Artificial Sequence: Synthetic coding sequence
atgtcgcgacaaacggcgacggcgttaccgacgggtacgtcgaaatgtccgccgtcgcaacgagtaccggcgttaacgggtacgacggcgtcgaataatgatttagcgtcgctatttgaatgtccggtatgttttgattatgttttaccgccgatattacaatgtcaatcgggtcatctagtttgttcgaattgtcgtccgaaactaacgtgttgtccgacgtgtcgaggtccgttaggttcgatacgaaatctagcgatggaaaaagttgcgaattcggttctatttccgtgtaaatatgcgtcgtcgggttgtgaaataacgttaccgcatacggaaaaagcggatcatgaagaactatgtgaatttcgaccgtattcgtgtccgtgtccgggtgcgtcgtgtaaatggcaaggttcgctagatgcggtaatgccgcatctaatgcatcaacataaatcgataacgacgttacaaggtgaagatatagtttttttagcgacggatataaatctaccgggtgcggtagattgggtaatgatgcaatcgtgttttggttttcattttatgttagtattagaaaaacaagaaaaatatgatggtcatcaacaattttttgcgatagtacaattaataggtacgcgtaaacaagcggaaaattttgcgtatcgtctagaattaaatggtcatcgtcgtcgtttaacgtgggaagcgacgccgcgatcgatacatgaaggtatagcgacggcgataatgaattcggattgtttagtatttgatacgtcgatagcgcaactatttgcggaaaatggtaatttaggtataaatgtaacgatatcgatgtgt

SEQ ID NO: 33634 - DNA, 846 bp, Artificial Sequence
  Description of Artificial Sequence: Synthetic coding sequence
atgtcacgtcagacagcaactgccctccctacaggcaccagtaagtgcccaccctcccagagggtccctgccctgactggaacaaccgcaagcaataacgacttggctagtcttttcgaatgccccgtgtgtttcgactacgtgctccccccaatcctgcaatgtcagtctggtcacctggtctgtagcaactgtaggcctaagctcacctgctgtccaacatgtcgcggtcccttgggttcaatcaggaacctcgctatggagaaggtagccaacagcgtactgtttccatgtaagtacgctagctccggatgtgagatcacactgccccacacagaaaaggccgaccacgaggaactgtgtgaattcagaccttacagctgcccatgcccaggtgctagctgtaagtggcaaggcagtctggacgccgttatgccccatcttatgcatcagcacaaaagcatcacaactctccagggcgaagacatcgtgtttctggctaccgatatcaatttgcctggagctgtagactgggtaatgatgcagtcttgtttcggctttcacttcatgctggtactcgagaagcaggagaagtacgacggtcatcagcagtttttcgcaatcgttcagctgataggaaccaggaagcaggctgaaaatttcgcctatcgcctcgagctgaatggacatcgccgtaggttgacttgggaagcaactcccagatctatccacgagggaatcgccactgctatcatgaatagcgactgccttgtgttcgacaccagtatcgctcaattgtttgctgagaacggtaacttgggtatcaacgtgacaatttcaatgtgc

SEQ ID NO: 33635 - DNA, 846 bp, Artificial Sequence
  Description of Artificial Sequence: Synthetic coding sequence
atgtctcgacagacagcaaccgctctgccgaccggaacctccaagtgtccaccctcgcagcgggtccccgcccttacgggtacaaccgcttccaacaatgatctggcatcattgttcgaatgccctgtgtgttttgattacgtattgccccctattctccagtgtcagtccgggcatttggtttgcagcaactgccgccctaagcttacctgctgccctacctgccgaggccctctaggtagtatcagaaatcttgctatggaaaaagttgccaactcggtcctctttccatgcaagtatgccagctcgggttgtgaaattacattgcctcacacagaaaaagccgatcacgaggaattatgcgaattccgaccctactcctgcccctgtccaggcgctagttgtaaatggcaaggcagcctagatgccgttatgccccacttgatgcatcagcataagagtatcaccaccctacaaggtgaggacattgtttttcttgctaccgacattaatttacccggggccgtggattgggtcatgatgcagtcgtgttttgggttccatttcatgctcgttttggagaaacaagaaaaatacgacggccatcaacaattttttgccatcgttcagctgatcggaactcgcaagcaggcagagaacttcgcgtataggcttgagttaaacggccatcgtcgtcgtctgacctgggaagctacccctcgctcgatccatgaaggaatcgcaaccgctattatgaactcggactgtctggtttttgacacatcaattgcccaactgttcgctgagaatggcaatctgggaatcaacgttacaatctcgatgtgt

SEQ ID NO: 33636 - DNA, 846 bp, Artificial Sequence
  Description of Artificial Sequence: Synthetic coding sequence
atgtcgcggcaaacggctactgctcttcctactggaacgtccaagtgccctccatcgcaaagggtgcctgcactgaccggtactaccgcgtccaacaacgacctggccagcctgttcgaatgccctgtgtgtttcgattacgtgctcccaccgatccttcagtgtcagtcaggccatttggtgtgctccaattgtcgtcccaagttgacctgttgcccgacttgcagaggaccactgggatctatccgcaacctcgcgatggagaaggtggctaattcagtgctcttcccttgcaagtacgcatccagcgggtgtgaaatcactctgccacataccgagaaggcggaccatgaagagctgtgcgaattccgcccatattcgtgcccatgccccggtgcttcatgcaagtggcaaggctcgctggacgcagttatgcctcacctcatgcaccagcacaaatcgatcaccacgctccagggagaggacatcgtgtttctggcgaccgatatcaaccttcccggcgccgtcgactgggtgatgatgcagtcgtgctttggcttccacttcatgctcgtgctggaaaaacaagagaaatacgacggacaccaacagttcttcgctatagtccagctgattggaacccggaagcaggccgaaaactttgcctaccgcctggaactgaatggacaccgccgacgcctcacttgggaagccactccgcggtcaattcatgagggaattgccactgccatcatgaactcggattgcctggtctttgatacctctatagcccaactgttcgccgagaatgggaacctcggaatcaacgtcaccatctccatgtgc

SEQ ID NO: 33637 - DNA, 846 bp, Artificial Sequence
  Description of Artificial Sequence: Synthetic coding sequence
atgtcgcgccagaccgcaactgcgctccctactggtacgagcaagtgtcccccctcacaaagggtgcccgccctgactggtaccactgcatccaacaatgacctcgctagcctgtttgaatgcccagtgtgtttcgattacgtcctcccaccaatccttcagtgtcaatccgggcatctggtttgcagcaattgcagaccgaagctgacctgctgccccacctgtagaggtcctctgggtagcataagaaaccttgcaatggaaaaagtcgcaaatagcgtcttgtttccctgtaaatacgcatcatccggttgtgaaattactctgcctcacaccgaaaaggcggatcatgaggagctgtgcgaatttagaccatattcctgcccgtgcccaggggcatcatgtaagtggcaaggatccctggatgccgtgatgccccatcttatgcatcaacataagagcataacgactctgcagggcgaggacatcgtgttcctggctactgatatcaaccttcctggtgcagtcgactgggtgatgatgcaaagctgtttcggatttcactttatgctcgtcctggaaaaacaagagaaatacgacggccatcagcagtttttcgcaattgtacagctcatcggaacccgtaagcaagcagaaaacttcgcataccgcctggaacttaatggccatagaaggcgtctgacttgggaggctacccctcggtcgatacacgaagggattgcaaccgcaattatgaacagcgattgtctggtctttgatacctcgatagcgcaactcttcgcagagaacggaaacctgggtattaacgtcactatctcaatgtgt

SEQ ID NO: 33638 - DNA, 846 bp, Artificial Sequence
  Description of Artificial Sequence: Synthetic coding sequence
atgtcacggcagacagccacggctctgcccacgggcacctcaaaatgcccccccagccaacgcgtgcccgcgttgacagggaccacagctagcaacaacgacttagcgtccttatttgagtgccccgtttgctttgattacgtgctgccgcctatcctgcagtgtcaaagtggtcacctggtctgcagcaactgccgtccaaagttgacatgctgccctacatgtaggggaccactcggcagcatcagaaacctcgctatggaaaaagttgcgaactcggttctctttccctgtaagtacgcaagcagcggttgcgaaatcacactgccgcacacggaaaaggccgaccatgaagagttgtgtgaattccgaccttattcatgcccatgccctggggcatcatgtaagtggcaggggtccttggatgcggttatgcctcacctaatgcatcaacacaagtcaatcacaaccctccagggagaggacattgtattcctcgccacagacattaatctgcctggcgcagtggactgggtgatgatgcagtcctgctttggctttcacttcatgctggtgctagaaaaacaggaaaagtacgatggtcaccaacagtttttcgcgatcgtgcaacttataggcactcggaaacaggccgagaacttcgcctaccgccttgagctaaacgggcaccgtcgcagactgacctgggaggctacgccgaggtccattcacgaaggcattgccactgcaatcatgaattctgattgtcttgtctttgacacctccatcgcccagctcttcgcagagaacggcaaccttggcatcaatgtgactatatcaatgtgt

SEQ ID NO: 33639 - DNA, 846 bp, Artificial Sequence
  Description of Artificial Sequence: Synthetic coding sequence
atgtctcgtcagaccgctaccgccctccccacgggcacttcgaagtgtcccccctcccagagggtgccggccctgaccggcactactgcctctaacaatgatcttgcctctctgttcgagtgcccagtgtgcttcgactacgtgctgccccccatcctgcaatgccagtccggacaccttgtttgtagcaactgcagacctaaactcacttgctgtcccacctgccggggtcctctgggatctattaggaacttagcgatggagaaggtggctaattctgtattattcccttgcaagtacgctagctcaggatgtgagataactttgccacacaccgaaaaagccgaccatgaggagctgtgcgaattccgcccttacagctgcccctgtcccggggcaagctgtaaatggcagggaagcctggacgccgtgatgccacacttgatgcaccaacataagtctattactacgctgcagggagaagacatcgtgttcctggctactgatatcaaccttccaggcgcagtggattgggtgatgatgcagtcatgctttgggtttcattttatgcttgtcctggagaagcaggaaaagtatgacggccatcagcagtttttcgccatagtacagctcatcgggacccggaaacaggctgagaatttcgcttacagactggagctaaacggccatcgacgacgactgacctgggaagcaacccccagatcaatccatgaagggatcgcaacagcaattatgaattctgactgcctggtgttcgatacaagcatcgcgcagttatttgcagagaacggaaatctgggcatcaacgtgacgatcagtatgtgt

SEQ ID NO: 33640 - DNA, 846 bp, Artificial Sequence
  Description of Artificial Sequence: Synthetic coding sequence
atgagtaggcagactgcgacagccctgcccaccgggacttcaaaatgccctcctagtcaacgggtgcctgccttaacaggcactaccgctagcaataatgaccttgcatctctttttgaatgtcctgtttgcttcgattatgtgcttccccctattctgcaatgccagagtgggcatctggtgtgctctaactgtaggcccaaactcacctgttgtcctacgtgtagaggtccccttggttccatcagaaacctggccatggaaaaggtggcgaactcagtgctgttcccatgcaaatatgcgtccagcggctgcgaaattaccctcccgcacacagaaaaagcggatcacgaggagctctgtgagtttcgtccatactcttgcccttgtccaggtgcgtcgtgcaaatggcaaggttctctggatgccgtgatgcctcacttgatgcatcagcacaaaagcatcaccacactacagggtgaagacattgtcttcctcgcgaccgacataaacctgccgggggcagtggactgggtaatgatgcagtcatgcttcgggtttcactttatgctggtgctggagaagcaggaaaagtacgatggccatcaacagttcttcgccattgtccagctcattggcacccggaagcaagcggagaactttgcctatagactggagctgaatggtcatcggagacgcctgacatgggaagccacccctagatcaatccacgaaggtatagctaccgccatcatgaattcggattgtctggtgtttgatacgtctatcgcacagctcttcgccgagaacggaaatctggggatcaatgtgacaatctctatgtgt

SEQ ID NO: 33641 - DNA, 846 bp, Artificial Sequence
  Description of Artificial Sequence: Synthetic coding sequence
atgtcccgacagactgcaaccgcactgcctaccggaactagcaaatgtccaccatctcagagagtgcccgccctgacgggaacgaccgcaagcaacaatgaccttgcttcactttttgagtgcccagtttgtttcgattacgtgctgccacccattcttcagtgtcaatccggtcacctggtctgctctaattgcaggccgaaacttacttgttgtcccacctgtagaggaccgctcggttcgatcagaaacctggcaatggaaaaggtggcaaactcggtgctgttcccgtgcaagtacgcctccagcggatgtgagattactcttcctcatactgagaaggcagaccacgaagaactttgtgagtttcgtccctactcctgtccctgcccgggagcctcgtgcaaatggcaaggttcgttggatgcagtaatgccccatctcatgcatcagcacaagtccattactaccctgcagggcgaggatatcgtgtttttggcaactgacataaatctgcccggtgctgtcgattgggtgatgatgcaatcatgctttggattccactttatgctcgtgcttgaaaaacaagaaaagtatgatggtcatcaacagtttttcgcgatcgtgcaacttataggaaccagaaagcaagcagagaactttgcatacaggcttgaattgaatggacatcggcgtaggcttacctgggaagccactcctagaagcatacacgaaggtattgcaaccgcaattatgaactccgattgtctggtttttgacacctcgatcgctcagctttttgcagaaaacgggaacctcggaattaacgtcaccatctcgatgtgt

SEQ ID NO: 33642 - DNA, 846 bp, Artificial Sequence
  Description of Artificial Sequence: Synthetic coding sequence
atgtctcgccagaccgctactgcgctgccgaccggaactagcaagtgcccccctagccagcgcgttccagcacttacaggtactacagcttccaataatgacctggcgagcctgtttgaatgtcctgtttgcttcgattacgtgctcccacccatccttcagtgccagtctgggcatcttgtgtgctcaaactgtaggcctaaactgacttgttgtccaacatgtaggggaccactgggtagcattaggaacctggctatggagaaggttgcaaacagcgtgctgttcccgtgcaagtacgcttctagcggatgcgaaatcacgctgccacacacagagaaagctgaccacgaagaactgtgcgagttccgaccatacagctgcccctgcccaggcgcctcttgtaaatggcaggggtcactggatgccgtcatgccacaccttatgcaccagcacaaatccatcacaacgcttcagggggaggatatcgtgttcctcgcaactgatatcaatctgccgggcgcagttgattgggtgatgatgcaatcctgcttcggtttccatttcatgcttgtgctggaaaagcaggaaaaatacgatggccatcagcagtttttcgctatcgtccaactcatcggaaccaggaagcaggcagagaactttgcctatcgcctggaacttaacggccatagaaggagattaacatgggaggcaaccccgcgatcaattcatgaaggcatagcgaccgcaataatgaattcagactgcttagtctttgatacatctattgctcagctatttgctgaaaatggcaacctgggcataaacgttacaatctctatgtgc

SEQ ID NO: 33643 - DNA, 846 bp, Artificial Sequence
  Description of Artificial Sequence: Synthetic coding sequence
atgtcccgacaaactgcaaccgccctgccaaccgggacttcaaaatgtccaccgagccaacgagtgccagccctcacgggtaccaccgcctcgaacaatgatctggcgtcgctttttgaatgccctgtctgttttgactacgtcctgccacctattctgcaatgtcagtcgggacatctggtatgtagcaactgtagacccaagctcacttgttgccccacctgtcggggaccacttggatcgattagaaacctggcaatggaaaaagtggcgaattccgtgctgttcccctgtaaatacgcatcaagcggctgtgagattaccctgccccataccgaaaaggcagatcacgaggaattgtgcgagttcagaccttacagctgcccgtgtcctggagctagctgtaaatggcaggggtcgctggatgcagttatgccccatttgatgcatcagcataagagcataactaccctccagggtgaagatatcgtgtttttggcgaccgacattaacctgccaggggcagtggattgggtcatgatgcagtcatgcttcggatttcactttatgcttgtcctggagaagcaagaaaagtacgatggtcatcaacagttttttgcaattgtgcagctgattggtactaggaagcaagcagagaacttcgcttaccgcctcgagcttaatggccatcgtagacggctgacttgggaggccactccaagatcaattcatgaaggtattgccaccgccattatgaattcggactgtctggtgtttgatacctctattgcacaactgttcgcagaaaacggaaatcttggaataaacgtgactatttcaatgtgt

SEQ ID NO: 33644 - DNA, 846 bp, Artificial Sequence
  Description of Artificial Sequence: Synthetic coding sequence
atgagccgtcagacagctactgccctgccaactggtacatcgaagtgtcccccttctcaacgggtccccgctttaacagggaccactgcctccaataacgatttagcctctctgtttgagtgtccggtgtgcttcgattacgtgctaccacctatcctgcagtgtcaaagtggacacctagtgtgctctaattgccgccctaaacttacctgttgtcccacatgtaggggacctttagggtcgattcgcaatcttgccatggagaaagtcgctaatagtgtgttgtttccgtgcaagtatgcttcctcaggttgtgagattacgctccctcataccgagaaggctgatcacgaggagctctgtgagtttcggccctatagttgtccgtgccccggagcttcctgcaagtggcagggctctctcgacgcagtgatgccacacctgatgcaccagcataagtccatcacaacactgcagggagaggacatagtctttctggcgacagacattaacctaccaggtgcagtggattgggtgatgatgcagagctgcttcggcttccacttcatgctggtgctggagaaacaggagaaatatgatggacaccagcagtttttcgccatcgtacagttgattggtacaaggaaacaggctgaaaactttgcctatcgccttgaactgaacgggcataggcggcgactgacatgggaggcaacccctagaagcatacacgaaggcattgctacagctatcatgaactccgactgcctcgtgtttgacacatccatcgctcagctctttgcagaaaatggcaacctggggatcaacgtgaccatctcgatgtgt

SEQ ID NO: 33645 - DNA, 846 bp, Artificial Sequence
  Description of Artificial Sequence: Synthetic coding sequence
atgtcacgccagactgctactgcgctgccaaccgggacctcgaaatgcccgccgtcgcagcgggtcccagcacttacgggcactactgcttccaataatgaccttgcttccctgttcgagtgcccagtttgtttcgactatgtcctgccgcccatcctgcaatgccagtccgggcatctggtgtgctcgaactgccgccctaagttgacgtgctgcccgacttgccggggaccattgggatcaatccgcaatctcgcgatggaaaaggtggccaactccgtgctgtttccatgtaagtacgcgtcctcaggttgcgaaataaccctcccgcacaccgagaaagctgaccatgaagagttgtgcgaatttagaccttacagctgtccttgccctggagcctcttgcaagtggcaaggtagcctcgatgctgtgatgccgcatttgatgcatcagcacaagtccatcactacccttcaaggcgaggacatcgtgttcctggcaaccgatatcaatctcccaggcgccgtggattgggtcatgatgcagtcatgtttcggattccatttcatgctggtgcttgagaaacaggagaaatacgacggacaccaacagttcttcgccatcgtccaactgattggtactcggaagcaggccgaaaacttcgcctaccggctcgaactgaacggccaccggagacggctcacttgggaggcaaccccacgctccatccacgaagggatcgctactgcaatcatgaatagcgattgccttgtgttcgatacctccatcgctcagctgttcgccgaaaatggaaatcttggaatcaacgtcaccatctccatgtgt

SEQ ID NO: 33646 - DNA, 846 bp, Artificial Sequence
  Description of Artificial Sequence: Synthetic coding sequence
atgtccagacagactgctaccgccctacccaccggcacctcaaaatgtccacccagccagcgtgtgccagctttaacaggcaccactgcctctaacaatgacctcgcttctctgttcgagtgtcctgtatgcttcgattatgtgttaccgcccatcctccagtgccagtccgggcatctggtttgttccaattgcaggcccaaactcacctgttgccccacctgtaggggcccattgggatctattcggaatttagctatggagaaagtggccaatagcgtcttgtttccttgtaagtacgcaagcagtggatgcgaaataactctaccacacacagagaaggccgatcacgaggagttgtgcgaattccgtccttattcctgtccatgtcccggagcatcctgcaagtggcagggctccctggatgctgtgatgccacatctcatgcatcaacacaagtccatcaccaccctacagggggaggacatagtttttctagcaaccgatataaacttacctggcgccgtggactgggtgatgatgcagtcctgttttgggtttcatttcatgttggttctggagaaacaagagaagtacgatggccaccagcaattcttcgctatcgtccagctgataggcactagaaagcaggcagagaattttgcctatcgcttggaactgaacggccaccgtagacgactgacttgggaggcaacccctcggagcatccacgaggggattgccaccgccatcatgaacagcgattgcctggtgtttgacacctccattgctcaattattcgcagagaacggaaatctgggcattaatgtgacaatctccatgtgt

SEQ ID NO: 33647 - DNA, 846 bp, Artificial Sequence
  Description of Artificial Sequence: Synthetic coding sequence
atgtcaaggcagacagccaccgcgctgccgactggcacctctaagtgcccgccctcccaacgcgtaccggccctgaccgggacaaccgcctctaacaacgaccttgcctctcttttcgagtgccctgtttgttttgattacgtgctgccccctattctgcagtgccaatctggtcacctggtgtgtagtaattgtaggcctaaacttacctgttgtcctacctgtcgtggtcctcttggcagtattagaaacctcgctatggagaaagtggccaactccgttctattcccctgcaagtatgcttcttctggctgcgaaattaccctgccccataccgaaaaagccgatcacgaggaattatgtgagtttcggccttactcatgcccatgccccggtgcttcctgcaaatggcaaggatcactggacgcggtgatgccccacttaatgcaccaacataagagtattacaacactgcagggagaggacatagtctttctggccaccgacatcaatcttcccggggctgtcgactgggttatgatgcagtcatgtttcggctttcactttatgctggtgctcgagaaacaggagaaatacgatgggcaccagcaattcttcgctatagtccagctgattggaacgcgaaagcaggccgagaactttgcgtatagattggagctgaacggacaccggagaagactgacatgggaggccactcctagatcaatacatgaggggatagccacagcaatcatgaatagtgattgcttggtgtttgatacctctattgcccagctgtttgctgagaacggaaatctgggaataaacgtgacaatcagcatgtgc

SEQ ID NO: 33648 - DNA, 846 bp, Artificial Sequence
  Description of Artificial Sequence: Synthetic coding sequence
atgagcaggcaaaccgccacagcgctacctaccggcacatctaagtgccccccatcccagagagtgcccgcgctgacaggaactacagcttcaaataacgatcttgcctctttgttcgagtgtcccgtgtgcttcgattacgtgctgccacccatactgcaatgtcagtcggggcatctggtttgcagcaattgtaggccaaagctgacatgctgcccaacctgtaggggtccattgggttctattcggaatttggctatggagaaagttgccaactcagtcctgttcccttgtaagtatgcttcttccggatgcgaaataactctgccacacacagagaaagcagaccatgaggaactctgtgagttccgcccctattcttgtccctgccccggagcctcttgcaagtggcaggggtctttggatgcagttatgccccatttaatgcatcagcacaaatccattacgaccctccagggtgaggatattgtcttcctggccactgatatcaatctgccaggggcggtggactgggtgatgatgcagtcctgttttggcttccactttatgcttgtgttggagaaacaggagaagtatgatggacaccagcagttctttgcaatcgttcagcttattggtacccggaagcaggctgaaaacttcgcgtaccggctcgagctaaacggtcacaggagacgacttacatgggaggctacaccgaggagcattcacgagggcattgcaacagcgatcatgaatagcgattgtctggtcttcgacacctcaatcgcccagcttttcgctgaaaatggcaatctgggtatcaatgtgaccatatcaatgtgt

SEQ ID NO: 33649 - DNA, 846 bp, Artificial Sequence
  Description of Artificial Sequence: Synthetic coding sequence
atgagcaggcaaaccgctaccgctctgcctacaggcaccagcaagtgtccaccttcgcaacgcgtaccagccctgaccggtacaaccgcaagcaacaacgacctggccagtctcttcgagtgtccagtatgcttcgactacgtgctgcccccaatactccagtgtcaatcgggacacctggtctgcagcaactgccgccccaagttgacctgttgccctacctgcagaggaccactcggaagcattcgtaaccttgcaatggagaaagtcgctaacagcgtgctgttcccttgcaagtacgcctcgagtggatgtgagataactctccctcatacagaaaaagcagatcacgaggagttatgcgagtttaggccctacagctgcccgtgtccaggtgctagctgtaaatggcaaggatctctggatgcagtcatgccacaccttatgcaccaacacaagagcatcaccacacttcagggcgaagatatcgtcttccttgctactgatatcaaccttcctggcgctgtggactgggtgatgatgcaatcctgcttcggattccactttatgctcgtcctggaaaagcaggagaagtacgatggacaccagcagttcttcgctattgtccagctgatcggaacccggaaacaggcagaaaactttgcttataggcttgagttgaatgggcacaggcggcgcttgacgtgggaggctacacctcgcagcattcatgagggtattgcaacagcaattatgaattctgattgcctcgtgttcgacacaagcatcgcacagctttttgctgaaaatggcaaccttggaattaacgtgacaatatcaatgtgc

SEQ ID NO: 33650 - DNA, 846 bp, Artificial Sequence
  Description of Artificial Sequence: Synthetic coding sequence
atgtcgagacagacggccactgcgttgcctaccggcacttctaagtgccctccatcccaacgcgtgccagcactgacgggaaccaccgcctctaacaatgatctcgcgagccttttcgaatgtcctgtgtgcttcgactacgtcctgccgccaatcctgcaatgccagagcggacatctcgtgtgctcaaactgccggccgaaactgacttgctgtccgacttgcagaggacctctcggttccatccggaacctggccatggagaaagtcgctaactcagtactcttcccctgtaagtacgcctcgtcgggctgtgaaattactttgccgcatacggaaaaggctgaccatgaggagttgtgcgaatttagaccatactcctgcccgtgcccgggggcgagctgcaagtggcaaggatcgcttgacgcggtaatgccacacttgatgcaccaacacaaatccataaccacccttcagggagaggatattgttttcctcgcaaccgacatcaacctgccgggtgctgtggactgggtgatgatgcagtcatgcttcggttttcacttcatgctcgtcctcgagaaacaggaaaagtacgatggacatcagcagttcttcgccattgtccaactgatcggaactcggaagcaggccgagaacttcgcttatcgtttggaactcaatgggcaccgcagacggctgacctgggaggctactccccgcagtatccacgaagggatcgctaccgcaatcatgaattcggactgcctggtgtttgatacctcgatcgcgcaactcttcgccgaaaatggtaatcttggcatcaacgtgaccatctcaatgtgc

SEQ ID NO: 33651 - DNA, 846 bp, Artificial Sequence
  Description of Artificial Sequence: Synthetic coding sequence
atgtctcgccagacagccaccgcattgcctacaggcacatcaaagtgcccaccgtctcagagggtgccagccttgactggtacaaccgcaagtaacaacgacctcgcctctttgttcgagtgtcccgtttgttttgactacgtcctacctccaattctgcagtgccagagtggacacttggtgtgtagtaactgtcggcccaagttaacgtgctgccccacctgcaggggacctcttggaagcattcgcaatcttgcaatggaaaaagtggcaaatagtgtcctgtttccatgcaagtacgcctcctccggatgtgagataacattaccccataccgagaaagcagatcacgaggaactttgtgagtttcggccctattcctgcccgtgtcccggagcttcgtgcaagtggcaggggtcattagatgcggtgatgccacatctcatgcaccagcataagtcaatcactactttgcagggggaggacatcgtgtttctcgccaccgatatcaacctcccaggggccgtggattgggtcatgatgcagtcctgctttggatttcacttcatgctagtgctcgagaaacaggagaaatatgatggacaccagcaattttttgctattgtccagctcatcggcacccgaaaacaggcggagaattttgcgtaccggcttgagctgaacggtcataggagacgcctgacctgggaagccactccacggtccatccacgagggcatcgctacagctatcatgaattccgattgcctcgtgtttgatacatcaattgctcaactgtttgctgaaaacggtaacctggggatcaatgtcacgatctcgatgtgt

SEQ ID NO: 33652 - DNA, 846 bp, Artificial Sequence
  Description of Artificial Sequence: Synthetic coding sequence
atgtctcgacagacggcaactgccctgcctaccggcaccagcaagtgtcccccgtcacagcgcgtcccagcacttaccggaactacagcctccaacaacgatttggcatctctgttcgaatgcccggtgtgcttcgactatgtgttacctcctatactgcaatgtcagagcggccaccttgtgtgctcaaattgtcgccctaagttaacgtgctgccctacttgccgaggccctcttggatctatcaggaaccttgcaatggaaaaggttgcgaattctgtgctgttcccctgtaagtacgcatcctctggctgcgagatcacgctacctcacaccgaaaaggccgaccacgaggagctctgcgagtttcgcccctattcctgcccatgcccaggcgcctcctgcaagtggcagggaagcctggatgccgtcatgcctcacctgatgcaccaacataaaagcatcaccacccttcagggcgaggacatagttttcctcgccacggatataaacctccctggcgccgttgactgggtgatgatgcagagctgtttcgggttccactttatgctcgtgctggagaaacaggagaagtacgacggacatcagcagttcttcgccatcgtccaactaatcgggaccagaaagcaggcggagaatttcgcataccggttggagcttaatggccatcgccgccgcctgacgtgggaagcaacaccccgatcaattcacgaggggatagcaacagcaattatgaacagtgattgcctggtcttcgatacatcaatagctcagttgttcgccgagaacggcaatttaggaatcaatgtcacaatctccatgtgc

SEQ ID NO: 33653 - DNA, 846 bp, Artificial Sequence
  Description of Artificial Sequence: Synthetic coding sequence
atgtccaggcagacggccaccgcactgcccacaggtacatccaaatgtccccccagtcagcgcgtacccgccctaacaggaaccacagcctcgaataacgacctggcctcattatttgagtgcccagtctgttttgattacgttctgccccccattctccagtgtcaatctggccaccttgtgtgttctaattgcagaccaaaattaacttgttgtcctacctgtagggggccactgggatcaatccggaatctggcgatggaaaaagtcgcgaacagtgttttgtttccctgtaagtacgctagctcaggctgtgagatcacactgccacacaccgagaaggcagaccatgaagagttgtgtgagttccgaccttactcctgtccgtgccctggagctagttgtaagtggcaagggtccctggatgcagttatgccccacctgatgcaccaacacaaaagcataaccaccctccagggagaggacatagtattcctggctacagatatcaaccttcctggcgccgtcgattgggttatgatgcagtcatgcttcggtttccacttcatgctggtgttggaaaagcaggagaagtatgacggccatcaacagttttttgctatagttcaattaatcggcacacgcaaacaggccgagaactttgcctatcgcctggagctgaacggccacagaagacgcctaacctgggaggccaccccccgctctatccacgaagggatagctaccgccataatgaattcagattgtttggtcttcgacacctccatcgcacagttattcgcagagaacggcaatctcggaattaatgtgaccatcagtatgtgc

SEQ ID NO: 33654 - DNA, 846 bp, Artificial Sequence
  Description of Artificial Sequence: Synthetic coding sequence
atgagtagacagactgcaacagccctgcccactgggacgtccaagtgccccccttcacagagagtgccagctctgactggcacgaccgcctcaaacaacgaccttgcttccttatttgagtgtcctgtgtgcttcgactatgtgctaccacccattctgcagtgtcagagcggccatttggtttgctccaactgccggcccaaattgacttgttgtccgacttgccgaggcccactaggatctatacgcaatctagccatggagaaagtggctaattcggtgctgttcccatgcaaatacgcttccagcgggtgtgaaataactttaccacatacggagaaggctgaccatgaggagctgtgtgaattcaggccctattcctgcccctgccctggagccagctgtaaatggcagggttcactggacgccgtgatgccacatctcatgcatcagcataaatctattaccactctacagggagaagacattgtgttcctcgctaccgacattaatcttcccggcgctgtcgactgggtgatgatgcagtcttgcttcggctttcactttatgctcgtcctggagaagcaggagaagtacgacggacaccagcagttttttgcaatcgtgcaattgattggcacacgaaagcaagccgagaactttgcataccggctggagttaaacggccacagacggcgccttacatgggaggctacacctcgttccatccatgagggtatcgccacggccattatgaattcggattgcctcgtttttgacaccagtatagcccaattgttcgcagagaacggaaaccttggtataaacgtgacgatttccatgtgt

SEQ ID NO: 33655 - DNA, 846 bp, Artificial Sequence
  Description of Artificial Sequence: Synthetic coding sequence
atgtctcgacaaacagctactgcacttccaactgggaccagtaagtgcccgccttctcagagagtccctgccttgactggaaccactgcgagcaataatgacctcgcatctttgttcgagtgtcccgtctgttttgattacgtcctcccaccaattctgcagtgtcaatcagggcatttggtttgctctaattgcaggccaaaacttacttgctgtccaacatgccggggacctcttggttcaataagaaatctcgcaatggagaaagttgccaattccgttctattcccatgcaagtacgcttcctccggatgtgagataacccttccgcacaccgagaaagccgaccatgaagagttgtgtgagttccggccatattcttgtccctgcccaggagcatcctgcaaatggcagggaagcctcgacgcagtgatgcctcatctcatgcaccaacataagtcaattaccactctccaaggagaagacattgtattccttgcaactgatattaatctaccaggtgcagtcgattgggtaatgatgcaatcatgctttggattccactttatgctggttttggaaaaacaagaaaagtatgatggacatcaacaattctttgcaatagtacaacttattggaacaagaaaacaggcagagaactttgcatatcgactggaattgaatggacatcggcgacgattgacatgggaagctacgccacgctctatccatgaaggaattgccactgcaatcatgaactctgattgtttggtttttgacacatctattgcccagttgtttgctgaaaacggaaacctcggaattaacgtgacaatctccatgtgc

SEQ ID NO: 33656 - DNA, 846 bp, Artificial Sequence
  Description of Artificial Sequence: Synthetic coding sequence
atgtcaaggcaaactgccactgctctgccaacggggacttccaaatgtcctcctagccagcgcgtgccagccctgactggaaccacggcatcaaacaacgacctggcgagcctttttgaatgtcctgtgtgttttgactatgtgctgccacctattctccaatgtcagtcaggtcatcttgtctgctcaaattgtagaccgaaacttacttgttgtccaacctgccgcggcccactggggagcatccgtaacctggcaatggaaaaggtggcaaactcggtgctgtttccctgtaagtacgccagctcgggttgcgaaatcactcttccgcacacggaaaaggcggatcacgaagagctctgtgagttccggccgtactcctgcccttgcccaggtgcctcgtgtaaatggcaaggttccctggatgcagttatgccgcaccttatgcatcagcataaatcgatcactaccctgcaaggagaagatatagtgttccttgcaactgatatcaatctccctggggccgtggactgggtcatgatgcaatcgtgcttcggcttccatttcatgctggtcctggagaaacaagagaaatacgacggtcaccaacagttctttgcaattgtccagctcataggaactcgaaagcaagcagagaatttcgcataccgtcttgaactgaatggccatcgcaggcgacttacttgggaggcaaccccacgaagcattcacgaaggtattgccactgctatcatgaactcggattgcctggtctttgatacctcgatagcccagctttttgcggagaacggtaaccttggtatcaacgtgaccatctctatgtgt

SEQ ID NO: 33657 - DNA, 846 bp, Artificial Sequence
  Description of Artificial Sequence: Synthetic coding sequence
atgtcccggcagacagcgaccgcccttcctactggcacatcgaaatgcccccctagtcagcgggtgcctgcccttaccggaacaacagcctccaacaatgaccttgccagcctctttgaatgccccgtttgcttcgactatgtgctgcccccaatcctgcagtgtcaaagcgggcacctggtgtgctcaaattgccgaccaaagctcacctgttgtcctacctgcagggggcccttgggaagcattcgaaaccttgctatggagaaggtggcaaacagcgtgctgtttccatgcaagtacgccagctctggctgtgagatcactttaccgcacacagagaaggccgatcatgaggagctctgcgagtttagaccttattcatgtccctgccctggggccagttgcaagtggcagggcagcttagacgccgtcatgcctcatctgatgcatcaacacaagtcaataaccactctgcagggcgaggatattgtgttcttagctacggacatcaatctcccgggcgcggtggattgggttatgatgcagtcctgttttggcttccatttcatgctcgtgcttgagaaacaggaaaagtacgatggacaccaacagtttttcgccattgtgcagctcatcggcactcggaaacaagccgaaaatttcgcctacaggctggagctgaacggccacaggcgcagactgacttgggaggcaactccacgttctatccacgagggtatagctaccgctatcatgaactctgactgcctcgtttttgatacctccattgcacagttgttcgcagagaatggcaatctgggtattaacgttaccatttcgatgtgt

SEQ ID NO: 33658 - DNA, 846 bp, Artificial Sequence
  Description of Artificial Sequence: Synthetic coding sequence
atgtcacggcaaactgccacagcccttcctaccggcacatccaagtgtcctcccagccagcgtgtgcctgccctaacagggacaacagccagcaacaacgacttggcatccctgttcgagtgtccagtctgtttcgactatgttctccctccaatcctgcagtgccagtccggccacttggtgtgctctaattgtcggcccaaactgacttgttgtcctacatgcaggggaccactcggcagcatccgaaatctagccatggaaaaagtggccaactctgtgctctttccttgtaaatacgcaagctcaggttgtgagattacactccctcacactgaaaaagcggatcacgaagagctgtgcgagttcagaccctattcttgcccgtgcccaggcgcgtcttgtaaatggcagggctcactcgacgccgttatgccccacctgatgcaccagcacaaaagtatcaccactctacaaggggaggatattgtttttttggccacagatatcaacctccctggcgccgtcgactgggtgatgatgcagtcctgtttcggattccacttcatgttggtattagaaaagcaagagaagtacgatgggcaccaacagtttttcgctattgttcagctcataggcacccgaaaacaggcggagaactttgcatatcggcttgagcttaacgggcaccgcaggcggctgacctgggaggcaactccccggagcatccacgagggcatagcaacagccataatgaattctgactgtctggttttcgatacttccattgcccagctgtttgcagaaaatgggaacctagggatcaatgtgacaatctcaatgtgc

SEQ ID NO: 33659 - DNA, 846 bp, Artificial Sequence
  Description of Artificial Sequence: Synthetic coding sequence
atgtcgagacagaccgctactgcactgccaactggaacctccaagtgtccaccatcccaacgcgtcccagcattgactggtaccacggcatcgaacaacgatctggcatcgctgttcgaatgtcctgtgtgtttcgattatgtgcttcctcctatcctgcagtgtcagtccggtcatctcgtttgtagcaactgcagacctaagctgacctgttgcccaacttgtagaggtcctcttggttcgattcggaacctggcaatggaaaaagtcgccaattcggtgctgtttccatgcaaatatgccagctcaggatgtgaaattaccctgccacataccgaaaaagcagatcatgaagagctgtgcgagtttagaccttactcctgcccatgccccggtgcctcctgtaagtggcaaggctcactggatgcggtcatgccccatctcatgcatcaacacaagtcgattactacgcttcaaggcgaagatatcgtgtttctggcgacggacattaacctgcctggagcagtcgattgggtgatgatgcagtcctgttttggcttccatttcatgcttgtcctcgagaaacaggaaaagtacgatggacaccagcagttttttgcgattgtgcagctgatcggcacccgcaaacaagcagagaactttgcctacaggcttgagcttaacggtcatcgacggagacttacttgggaagcaactcctcggtcgattcacgagggaattgccaccgccattatgaactcggactgcctggtctttgatacctcgattgcgcaactgtttgccgaaaatggaaaccttgggataaatgtcaccatctcgatgtgt

SEQ ID NO: 33660 - DNA, 846 bp, Artificial Sequence
  Description of Artificial Sequence: Synthetic coding sequence
atgtctcgccaaactgcgacggccctgcctactggcacctcaaaatgtcctccttcgcaacgcgtgcctgcccttactggcactaccgcttcaaacaacgatctggcatccctcttcgagtgtcctgtgtgcttcgactacgtgctgccccctatacttcaatgtcagtcgggacaccttgtgtgttccaactgcaggcctaaactgacctgttgtcctacctgtagaggtcctttgggttccattcgtaacctggcaatggagaaggtggcaaattccgtgctgtttccctgcaaatacgcaagctcgggttgtgaaatcaccctgcctcataccgaaaaagcagaccatgaggagctgtgcgagtttagaccatattcgtgtccttgtccgggtgcgagctgtaagtggcaaggaagcctggatgcagtcatgcctcaccttatgcaccagcacaaaagcatcactactcttcagggagaggatatagtgttcctggcaactgatatcaacctccctggtgcagtggattgggtcatgatgcagtcgtgctttggatttcacttcatgcttgttctggagaagcaggaaaagtacgacggacatcagcagttttttgccattgtccaactgattggaactcggaagcaagcagaaaactttgcataccgcctcgaactcaacggccatagacgacgcctgacctgggaagcgactccaagaagcattcatgaaggaattgcgactgcaataatgaattcggattgtctggtctttgacacctcaatcgctcagctgttcgcagaaaacggaaaccttggtatcaatgtcacgattagcatgtgt

SEQ ID NO: 33661 - DNA, 846 bp, Artificial Sequence
  Description of Artificial Sequence: Synthetic coding sequence
atgtcgcgccaaaccgctaccgccctgccaactggtacctctaagtgccccccctcccagcgagtgcccgctctgaccggcaccaccgccagcaacaatgatttagcgagtttgtttgagtgccccgtgtgtttcgactacgtgctgcccccaatcctgcagtgccagagtggacacctcgtgtgtagtaattgtcggcctaaacttacgtgttgccccacttgtagagggcctctgggttcaattagaaacctggcaatggaaaaggtggcaaattctgtgcttttcccttgtaagtacgcttcaagtggatgtgaaattacgttgcctcacaccgagaaggccgatcacgaagagctttgcgaatttcggccctattcctgcccctgtcctggagcaagctgtaagtggcagggatccctagacgctgtcatgccccatctgatgcaccagcacaaaagcattactactctccagggcgaggacatcgtattcttagctaccgatatcaatctgccgggcgctgttgactgggtaatgatgcagtcctgctttgggttccattttatgcttgtcctggaaaagcaggagaaatacgacgggcaccagcagtttttcgccatcgttcagctgatcggtacaaggaaacaggccgagaacttcgcttacaggctggagttgaacggacatagacggcggctgacgtgggaggctacccctaggtccatccacgagggcatagccacagccatcatgaacagcgactgtcttgtgtttgatacgtcaattgcccagctgttcgcagagaacggcaatctgggcattaacgttacaataagtatgtgc

SEQ ID NO: 33662 - DNA, 846 bp, Artificial Sequence
  Description of Artificial Sequence: Synthetic coding sequence
atgtccaggcaaaccgcgacggccttgccaacggggacttcgaaatgcccgcctagccaaagagtgccggccctcactggaaccaccgcctctaataacgacctcgcctccctgttcgagtgccctgtgtgcttcgattacgtgttgccgcctattctgcagtgccagtctggacacctcgtctgctccaattgccgcccaaagctcacctgttgtcccacctgcagaggcccgctgggctcgatccggaacctggccatggagaaggtggctaacagtgtgctttttccgtgtaagtacgccagctcgggatgcgaaatcaccctgccgcacactgaaaaagcagatcacgaagagttgtgtgaattccgcccttactcgtgcccatgcccgggagcctcctgcaagtggcaaggatcgctggatgcagtcatgccacatcttatgcaccaacataagagcatcactaccctgcagggcgaggacatcgtgtttctggcaaccgatatcaatctcccgggcgccgtggactgggtaatgatgcagagctgcttcggtttccatttcatgctggtgttggagaaacaggaaaagtacgatgggcaccaacaattcttcgctattgtccagctcatcggaactcgcaaacaggcggaaaacttcgcctaccggctcgagctcaatgggcacagacggcggttgacttgggaagccactccacggtccattcacgagggaatcgcgactgcgatcatgaacagtgattgtctggtgtttgatacgagcatcgcccagttgtttgccgagaacgggaacctcggaatcaatgtgacgatctcgatgtgc

SEQ ID NO: 33663 - DNA, 846 bp, Artificial Sequence
  Description of Artificial Sequence: Synthetic coding sequence
atgtccaggcaaaccgcaactgccctgcctacaggtacatctaagtgtcctccatcccaaagagttccagctcttacaggtacgactgcatccaacaacgatttggccagcctgttcgaatgccccgtctgcttcgattacgttctgcctccgatcctgcagtgccaatccggtcacctggtctgtagtaattgtagacccaaactcacttgctgccctacatgtaggggacctttgggctccattcgcaatcttgcgatggagaaggtagctaactctgttttgtttccctgtaagtatgcctcatcaggatgcgagatcacccttccacacactgaaaaggctgatcacgaagagctttgtgaatttaggccatacagctgcccctgtcctggtgcgagttgcaaatggcaaggttcattggatgctgtcatgcctcacctcatgcaccagcacaaaagtatcacgaccctccagggcgaggacattgtcttcctggctactgatataaatctccctggagctgtggactgggtgatgatgcagtcttgtttcggattccacttcatgttggtgctcgaaaagcaggaaaaatatgatggacatcagcagttttttgctatagtgcagctgatcggaaccaggaagcaagctgagaacttcgcctaccgcctcgagctgaacggccacagacgcagactgacctgggaagccactcctcgctccatccacgagggaatcgccactgccatcatgaactccgattgcctcgtttttgatacatctatcgcacagctcttcgctgagaacggaaacctgggaatcaacgtcacgatcagcatgtgc

SEQ ID NO: 33664 - DNA, 846 bp, Artificial Sequence
  Description of Artificial Sequence: Synthetic coding sequence
atgagtaggcagactgccactgcgctgcccacaggaacatctaaatgtccccccagtcagcgggtgccggctttaacagggacgacagcctctaataacgatctggcttccctgtttgaatgccccgtgtgcttcgactatgttcttcccccaattcttcagtgtcagtccggacacctcgtgtgtagtaactgtcggcccaaactaacatgttgccctacttgtaggggacccctcggatccattcggaaccttgctatggaaaaggttgctaattctgtgctgttcccttgcaagtacgcctcgtccgggtgtgaaatcactctacctcatacagaaaaagctgatcatgaggaactatgcgagtttcggccttacagttgtccttgccccggagcatcatgtaaatggcaggggtccctcgatgctgtgatgcctcacctcatgcatcaacataaatcgataacaacactccagggggaagatatagtattcttagccacagatattaatctacccggggctgttgactgggtcatgatgcagtcatgttttggattccactttatgcttgttctagagaaacaggaaaaatacgatgggcaccagcagtttttcgccatcgtccagctaatcgggactaggaaacaggcggaaaatttcgcctatcggctcgaactgaacggacacaggcgcaggctcacatgggaagccacaccaagatcgatccacgaaggaattgcaacagctatcatgaattctgattgtttagtatttgatacatctatcgcacagctgtttgccgagaatggaaacctgggaatcaacgtgactataagtatgtgt

SEQ ID NO: 33665 - DNA, 846 bp, Artificial Sequence
  Description of Artificial Sequence: Synthetic coding sequence
atgagcaggcaaactgctacggcgctccccaccggcaccagcaagtgtccaccatctcagcgtgtaccggcgctgacggggacaactgcctctaataacgacctggcaagcctgtttgaatgccctgtgtgtttcgattacgttctgcctcctatcctgcagtgtcagagtgggcacctggtctgcagcaattgtcgccctaagttgacctgttgtcctacgtgtcggggcccgctgggttccatccgcaatttggccatggagaaggtggccaactccgtgttgtttccgtgcaagtatgcgtcgagtggttgcgaaatcaccctgcctcacaccgagaaggccgaccacgaagaactgtgcgagttccgcccatatagctgcccatgtcctggcgcaagctgtaagtggcaaggttcattggatgcggtaatgccacacttgatgcaccaacataagagtataactaccctgcaaggcgaagatatcgtgtttctcgcaacggacatcaatttgccaggcgccgttgattgggtgatgatgcagagctgtttcggctttcattttatgctggtgctggaaaaacaagagaaatatgatggccaccaacaattttttgctatcgtgcagctgatcggcacccggaagcaagctgaaaacttcgcctaccgcctggaacttaatggacataggcgtaggttgacttgggaagcgactcctcgttccatccacgaaggtattgcaaccgcaatcatgaatagcgattgtctcgtgtttgacacaagcattgcgcagctctttgcggagaatgggaacctgggcataaacgtcaccatctctatgtgc

SEQ ID NO: 33666 - DNA, 846 bp, Artificial Sequence
  Description of Artificial Sequence: Synthetic coding sequence
atgtctcgccaaacggcgaccgcgctcccaaccggtacctcgaagtgcccccctagtcagcgggtccctgcactgacgggcaccaccgcctccaataacgacctggccagtctctttgaatgcccggtgtgcttcgattacgtgttgccccctattctccagtgccaaagcggacacctggtgtgttcgaattgccgcccgaagttgacctgttgccctacttgtcgggggccactgggctccatccgtaacctggcgatggaaaaggtcgccaatagcgtcctcttcccctgcaagtacgcatcgtcaggatgtgagatcactcttccgcacactgaaaaggcggaccacgaggagctctgtgagttcaggccttactcgtgtccgtgccccggagcgtcgtgcaaatggcagggcagcctggacgccgtgatgcctcacttgatgcatcagcataagtccatcaccacgttgcaaggagaagatatagtgttcctggccactgatatcaacctgccgggagctgtggattgggtgatgatgcaaagctgcttcggtttccactttatgctcgtgctggagaagcaggaaaagtatgacggccatcagcagttcttcgcaatcgtgcagctgatcggaaccaggaaacaagcagagaacttcgcctaccgcctcgaactcaatggccatagacggcggctcacttgggaggctacgccaagatccattcatgagggaattgctaccgccatcatgaactcagactgcctggtctttgacacttcgatcgcacagctgttcgccgaaaatggaaacctcggtatcaacgtaactatctccatgtgc

SEQ ID NO: 33667 - DNA, 846 bp, Artificial Sequence
  Description of Artificial Sequence: Synthetic coding sequence
atgtcccgacagaccgccacagccctccctacaggtacgtctaaatgtcccccgtcccagagagttccggccctcaccgggacaaccgcatcgaataacgatctcgctagtctattcgaatgtcccgtgtgtttcgattacgttcttccaccaattcttcagtgccaatctgggcatttggtctgctcaaattgcaggcccaaacttacttgctgccctacatgccgagggcctctgggctctatccgtaacctggccatggagaaggttgccaactctgtgttgttcccctgtaaatatgccagttccggttgcgagataacccttcctcacactgagaaggctgaccatgaagaattatgcgagttccgcccttattcctgcccttgtccgggggcatcttgcaagtggcagggctctctcgacgctgttatgccccacctgatgcaccagcataagtccatcaccaccctgcaaggtgaagacattgtcttcctggccactgacatcaacctccccggggctgttgattgggtgatgatgcaatcctgcttcggcttccacttcatgctggtgctggagaaacaggagaagtacgacggccaccagcagttctttgcaatcgtgcaactgatcggcacacggaagcaggctgagaattttgcttaccggctggaattgaatgggcataggcgaaggctaacctgggaggccacacctagatcaatccacgagggtattgccactgcgattatgaactccgactgtctggtgtttgacacctcaattgcacagctgtttgccgagaatggtaacctggggatcaacgtgactatttccatgtgc

SEQ ID NO: 33668 - DNA, 846 bp, Artificial Sequence
  Description of Artificial Sequence: Synthetic coding sequence
atgtctcgacaaaccgccaccgccctccccaccgggacctccaagtgccctcccagccagagagtgcctgctttgactggaacaactgcgtccaataatgacctggcatccctttttgagtgccctgtctgcttcgattacgtgctgccacccatcttacaatgccaaagtggacacctggtttgcagcaattgtcggccgaaattgacatgttgtccaacttgtcgaggacccctcggttcaattcgcaatttagctatggagaaggttgctaacagtgtcttgttcccgtgcaagtatgccagttctggctgcgaaattaccctacctcacactgaaaaggctgatcacgaggagctgtgcgaatttcgaccctacagttgtccctgcccaggggccagctgtaagtggcagggatctttggacgcggtgatgccgcatctgatgcaccagcataagtccatcactaccctacaaggagaggacatcgtgttccttgccactgatatcaacctgcctggcgccgttgattgggtgatgatgcagagttgcttcggatttcattttatgttagtactggagaaacaggagaagtatgacgggcaccagcaattcttcgccatcgtacagctgatcggcacacgtaaacaggcagaaaacttcgcttaccgattggagctgaatggccaccgacgacgattgacttgggaagccaccccaaggtcaatacacgagggtatcgctacggctatcatgaactcagattgtctagtgtttgacacttcaattgcgcagctgtttgccgagaatgggaatcttgggattaatgtgaccatttcaatgtgt

SEQ ID NO: 33669 - DNA, 846 bp, Artificial Sequence
  Description of Artificial Sequence: Synthetic coding sequence
atgagcaggcagactgcgactgcccttccgactgggacctcgaagtgtccgccgtcgcaacgagtgccggcgctgactggaaccactgcgtcgaacaacgacctggcgtctcttttcgaatgtcccgtctgttttgattacgtcctgcctcccatcctccagtgccaatcaggacacttggtgtgtagcaactgcagacctaagctcacgtgctgccctacctgccgcggaccgctcggttcaattcgaaatctcgccatggagaaagttgctaatagcgttctgttcccgtgtaagtacgcaagctccggatgcgaaattactttgccacacaccgagaaagcggatcatgaggaactgtgcgaattccgcccgtactcttgcccatgtcccggcgcctcctgcaagtggcaaggatcgctcgacgcggtcatgccacaccttatgcaccaacacaagtcgatcactactttgcagggtgaagatattgttttccttgcaaccgacatcaatctcccgggagctgtggattgggtgatgatgcaatcctgctttggattccacttcatgttggtgctggagaagcaggaaaagtatgacggtcaccagcaattctttgccatcgtgcagctgataggtacccgtaagcaggctgagaactttgcctaccgccttgagctcaatggacacagacggagactgacttgggaggctacgccgcggtccatccatgaaggaatcgccaccgctatcatgaacagcgactgtctcgtctttgacacctcgatcgcgcagctgttcgccgaaaatgggaacctgggcatcaacgtgaccatctccatgtgt

SEQ ID NO: 33670 - DNA, 846 bp, Artificial Sequence
  Description of Artificial Sequence: Synthetic coding sequence
atgtccagacagactgccacagctttacccaccggcactagtaaatgccccccatcccagcgagtccccgcactgaccggaacgaccgcttcaaataatgacctggctagcctgtttgagtgcccagtgtgcttcgattacgtgctgccccctatactccagtgtcaaagcggccatctggtctgcagtaattgcagaccgaaactgacatgctgccctacttgccgagggccactggggtctattaggaatctggctatggaaaaggttgccaacagcgtgctcttcccttgtaagtacgcctcctcaggctgtgagatcacactgcctcacaccgaaaaagcagatcatgaggagctgtgcgaattcagaccgtactcttgtccttgcccaggcgcctcttgcaaatggcagggcagcctggatgcggtgatgccccatctaatgcatcagcataagagcattactaccctgcagggagaggacatcgtgttcttagccactgacattaacctgcccggcgccgtggattgggtgatgatgcagagttgttttggcttccacttcatgctcgtccttgaaaagcaggagaaatacgacggacatcagcagttcttcgctatcgtgcagctcattggtacacggaagcaggccgaaaattttgcctaccgcttagagctgaacggccacagacgcaggttgacttgggaggccacaccccggagcattcacgagggtattgccaccgcaatcatgaactctgactgtctggtgtttgatactagtattgcacagctttttgccgagaatggcaacctcggtattaacgtgaccatctcaatgtgt

SEQ ID NO: 33671 - DNA, 846 bp, Artificial Sequence
  Description of Artificial Sequence: Synthetic coding sequence
atgtcccggcagaccgctacggcactgcctaccgggacgagcaagtgcccaccatcccaaagggtgcccgcactgaccggaacaacagcatctaacaacgacctggcctctctgttcgagtgtccggtctgcttcgattatgtgctgccacctattttgcaatgccagtcaggacacctcgtttgctccaattgcagacctaagctcacatgttgtcccacttgccggggtcccctcggatctatcaggaacctcgccatggagaaagtcgcgaattcagtactgtttccatgtaagtacgcttcttctggctgtgagatcaccctccctcatacggagaaggccgatcatgaggaactgtgcgagttccggccatacagttgcccctgtccaggcgcttcctgcaagtggcaagggagtctcgatgctgtgatgccccacttgatgcaccagcacaaaagtattacaacgctgcaaggcgaggatatcgtgtttcttgccacagatatcaatctcccaggagccgtagattgggtaatgatgcagagctgcttcggcttccattttatgctcgtcctggagaaacaggagaagtatgacggtcatcagcagtttttcgcaatcgttcagctgatcgggactcgaaaacaggcggagaacttcgcttatcggctggaattgaatggccataggcgccgactgacctgggaagccactcccaggtcaatccatgagggcatagccacagctattatgaattcagactgcctggtgttcgataccagcattgcacagctgtttgccgaaaatggcaatctgggcatcaatgttacaattagcatgtgt

SEQ ID NO: 33672 - DNA, 846 bp, Artificial Sequence
  Description of Artificial Sequence: Synthetic coding sequence
atgtcaaggcagactgccacagcccttcccacagggacatcaaaatgccctccgtcacagagggttcccgctctgacagggacaactgcatctaataacgatctggcctccttgttcgaatgtccagtgtgctttgattatgtgctccctccaatccttcagtgccagtctgggcacctggtgtgctccaattgcagacccaagctgacatgttgtccaacatgtaggggacccctagggtccattagaaatctcgctatggaaaaagtggccaattctgtactcttcccatgcaaatacgcgtcaagtgggtgtgagattacactaccacacactgaaaaagcagaccatgaagaactatgcgaatttaggccttattcatgtccctgtcctggggcttcctgtaaatggcagggatcccttgatgctgtaatgccacaccttatgcaccagcataagtccataacaacacttcagggggaagatattgtattcctggcgactgatataaaccttcccggagcagtggattgggtgatgatgcaatcatgctttggattccactttatgctggtgctcgagaaacaagaaaagtatgatgggcatcagcagttcttcgcaatcgtccagttgatagggacacggaaacaggctgaaaattttgcctatcggctagaactcaatgggcatcgacgcaggctaacgtgggaagcgactccaagatcaatacacgaagggatagcaactgcaattatgaattccgattgtctggtgtttgatacttccatcgctcagctgttcgccgaaaacggaaacttaggaattaacgtaacaatctccatgtgt

SEQ ID NO: 33673 - DNA, 846 bp, Artificial Sequence
  Description of Artificial Sequence: Synthetic coding sequence
atgagccggcagacagcaacagccttgcccaccggaacgtcaaagtgcccccccagtcagcgagttccggcactgacaggaactacggcctccaacaacgacctggctagtctgttcgaatgccccgtgtgcttcgattacgtcttgcccccaatcctccagtgccagagcggacacctcgtttgtagcaattgccgcccaaagctgacctgctgcccgacttgcaggggtcctcttggtagtatacgtaatctggccatggaaaaagtagcaaactcggtgctattcccgtgtaagtacgctagctcaggctgcgagattacgttgccacatacagagaaggcggatcacgaggagctgtgtgaattccgaccgtactcctgtccgtgtccgggagcttcgtgcaagtggcaaggtagcttggacgcggttatgccccatctgatgcatcagcataaatccatcaccacgctgcagggtgaggacatcgtgttcttagcaaccgatatcaacctgccgggagctgtcgactgggttatgatgcaaagctgcttcggtttccacttcatgctagtcctcgaaaagcaggagaaatacgatggccatcagcagttcttcgcgatagtgcagctcattggtacgcggaagcaggcagaaaacttcgcatataggctggaattgaacggtcatcgtcgaaggctgacctgggaagccactccgcgctccattcacgagggaatcgctaccgccatcatgaactctgattgcctagtcttcgacacctccattgcccaactcttcgccgagaatggcaacctgggcatcaacgttacaataagtatgtgc

SEQ ID NO: 33674 - DNA, 846 bp, Artificial Sequence
  Description of Artificial Sequence: Synthetic coding sequence
atgagccggcagacagcaaccgcacttcccaccggcaccagtaagtgccctcctagccagcgggtgccggccctcacaggcaccaccgcctccaataacgacctagctagcctatttgagtgtccggtctgtttcgactacgtcctgccccctatactgcagtgtcaaagcggacatctggtgtgtagtaactgtaggccaaagttaacatgttgtcccacctgcagggggccattaggatccattcggaatctcgcgatggagaaagtggcaaacagcgtcctctttccctgcaaatacgcctccagtggatgtgaaattactttgccgcatactgagaaggctgaccatgaggaactttgcgagttccggccatactcctgcccctgccctggagcgagttgcaaatggcagggttcactcgacgccgtcatgccacaccttatgcatcagcacaagagcatcacaaccctccagggagaggacatcgtcttcctggctaccgacatcaacctcccgggggccgtggattgggtgatgatgcagtcttgtttcggttttcacttcatgttggttctcgagaagcaggagaaatacgacggccaccaacagtttttcgccatcgtccagctgataggcactaggaagcaagccgaaaattttgcctatcgactggagctgaacggccaccggcggcggctgacatgggaagccaccccaagatctatacatgaaggtatcgctaccgctatcatgaattcggattgtctggtgtttgacacgtccattgcgcagcttttcgctgagaatgggaacctcggcatcaatgttactatttcgatgtgc

SEQ ID NO: 33675 - DNA, 846 bp, Artificial Sequence
  Description of Artificial Sequence: Synthetic coding sequence
atgagccgtcagactgcaacggctcttcctaccggaacgtccaagtgtccaccatctcaaagagtccccgcactcactggtaccaccgcgtcaaacaacgatctcgcatccctctttgaatgtccggtctgttttgattacgtgctgccccccattcttcagtgtcaatcgggacatctggtctgtagcaattgcagaccaaagttgacctgctgtcctacctgtcgtggccctcttggttcgataagaaaccttgccatggagaaagtggcaaatagtgtcctctttccttgtaaatacgcgtcgagcggatgcgaaatcactctgccacataccgagaaagcggatcacgaagaactgtgcgagttccggccatattcttgtccttgccctggtgcctcgtgtaagtggcaggggtcgcttgacgccgtgatgccgcatctgatgcaccagcacaagagtatcaccactctccaaggcgaagatatcgtgttcctggcaactgacattaaccttcctggtgccgtggactgggtgatgatgcaatcttgctttggatttcatttcatgcttgttctggaaaagcaagaaaagtacgatggacatcagcaattcttcgcaatagtgcagctgatcggtacgcgaaagcaggctgagaacttcgcataccgcctggaactgaatggacataggcggcggctgacttgggaagcgactccacgatccattcacgaggggattgcaaccgcaattatgaacagcgactgcctcgtgtttgatacttccattgcgcaattgtttgcagaaaatgggaaccttggcattaacgtgaccatctcgatgtgc

SEQ ID NO: 33676 - DNA, 846 bp, Artificial Sequence
  Description of Artificial Sequence: Synthetic coding sequence
atgtcccgccaaacagccactgccctaccgactgggacctccaaatgccctccaagtcagcgggtgccggccctcacaggtactactgctagtaacaacgatctcgcaagcttattcgaatgtccagtatgttttgattatgtcctcccgccaatcttgcagtgccaaagcggccacctggtttgctccaactgcagaccgaagctgacctgctgccctacttgtaggggtccactcggctcaataaggaacctggcaatggagaaagtggctaactccgtcctgtttccgtgtaagtacgcatcctctggctgcgagattactctccctcacactgagaaggcggatcacgaggagctgtgcgaattccgcccttattcctgcccatgccccggggcctcctgcaagtggcaaggctcacttgacgcagtcatgccacacctgatgcaccagcacaaaagcatcacaaccctacagggagaagacatcgtgttccttgccacagatattaacctccctggagctgtcgactgggtgatgatgcagagctgtttcggatttcatttcatgctcgtgctcgagaagcaggaaaagtacgatggccaccagcagttcttcgctatagtgcagctgattggcactcgcaaacaggctgagaactttgcgtatcgacttgaactcaatggccatcgtcgaagattgacgtgggaagctaccccccggtccatacatgaggggattgctacagctatcatgaatagcgattgcttagtgttcgacacctcaattgcccaactgtttgccgaaaacggcaaccttggcataaatgtgaccatttcaatgtgc

SEQ ID NO: 33677 - DNA, 846 bp, Artificial Sequence
  Description of Artificial Sequence: Synthetic coding sequence
atgtcacggcagaccgccactgccctaccaaccggcactagcaagtgtcctccatcccagcgggtacctgcacttaccggtactactgcctccaataatgacctggcctcgctgtttgagtgcccagtgtgttttgactacgtgctaccacctatcctgcagtgtcaaagtgggcacttggtctgctccaattgccgacccaaactaacttgctgtccaacttgccgtgggccacttggaagcatcaggaatctggcaatggaaaaggttgcaaattctgtattgttcccctgcaaatatgcctcctccggatgcgaaatcactctgccgcatactgagaaggccgaccacgaggagctgtgtgaattccgaccatattcatgtccctgtccaggcgcctcttgcaagtggcagggtagcctggacgccgtgatgccgcatctgatgcaccaacataagtccatcaccaccctgcagggggaggatattgtttttcttgcgacagacattaatctccccggggctgtcgactgggtgatgatgcaatcttgtttcggcttccatttcatgctcgtgttagagaagcaagagaagtacgatgggcatcaacagtttttcgcgatagtacagttaatcggcacacgaaagcaggcagaaaactttgcctaccggttagagctcaatgggcacagacgacgcctgacatgggaagccacacctagatccattcacgagggtattgcgacagcaatcatgaactctgattgtctcgtcttcgatactagcattgcccagctgttcgcagagaatggcaacttgggaatcaatgtgactatctctatgtgt

SEQ ID NO: 33678 - DNA, 846 bp, Artificial Sequence
  Description of Artificial Sequence: Synthetic coding sequence
atgtctagacagacagctactgcactgcccactggcacatccaagtgccctccgagtcaaagggtgccggccctgactgggacaaccgcgtctaataacgacctcgcctcactctttgagtgccccgtgtgtttcgattacgttctcccacctatcctccagtgtcagtccggtcatcttgtctgttccaattgccggcctaaactgacgtgttgccccacgtgcagggggcctctgggttccataaggaacttggccatggaaaaggtggcaaacagcgtgctgtttccatgcaagtatgcttcgtcaggctgtgaaattacgttgccccacaccgagaaggcagaccacgaagagctctgcgagtttcgtccctactcctgtccttgcccaggtgcttcatgcaagtggcagggtagtctcgatgccgtcatgccgcacttaatgcatcagcataagtctataacaaccctacagggcgaggacattgtgttcctcgcaactgatatcaacctccccggggcagttgattgggtaatgatgcaatcatgtttcgggtttcactttatgctagttctggaaaagcaagagaagtacgacggccatcagcagtttttcgctattgtgcaattgatcggaacaaggaagcaggctgaaaatttcgcgtaccggttggagctgaacgggcaccggaggagactgacttgggaggcaaccccacgctccattcatgagggcattgccacagccattatgaacagcgactgcctggtgttcgacaccagcatcgcccagctgtttgccgagaacggcaatttaggcattaatgtgacaatctcaatgtgc

SEQ ID NO: 33679 - DNA, 846 bp, Artificial Sequence
  Description of Artificial Sequence: Synthetic coding sequence
atgagccggcagaccgccactgccctgccgactggaacctcaaagtgccctccgtcccaacgcgtcccagccctgaccggcacgaccgcatccaataacgaccttgcaagcctgtttgaatgtccagtgtgcttcgattacgtgctgccgcctatcctgcagtgtcagtccgggcacctggtgtgcagcaactgcaggccgaaactgacctgctgccccacctgcagaggccctctgggctcgatccgcaatctcgctatggagaaggtggcgaatagcgtgctcttcccatgtaagtacgcctcttccggatgcgagatcaccctgcctcacactgagaaagcagaccatgaagaactgtgcgaattcagaccatacagctgcccctgtccgggcgcctcctgcaaatggcagggatccctcgatgccgttatgccgcatctgatgcaccagcataagagcatcaccactcttcagggagaagatatcgtgttccttgcaactgacataaacctgccgggtgctgttgactgggtgatgatgcaaagctgctttggctttcactttatgttggtgctggaaaagcaagagaaatatgatggccaccagcagtttttcgctatcgtgcaactcatcggcactagaaagcaggcggaaaacttcgcctaccgcctggagctgaacgggcaccgccgtcgccttacgtgggaagctaccccacgctcgattcatgagggcatcgcaaccgcgatcatgaactccgactgcctggtgtttgacacctctatcgcccagctgttcgctgaaaacggtaacctgggaattaacgtgacgatctcgatgtgt

SEQ ID NO: 33680 - DNA, 846 bp, Artificial Sequence
  Description of Artificial Sequence: Synthetic coding sequence
atgtcaaggcaaaccgcaactgccctgcctaccggcaccagcaagtgcccgccatctcagcgcgttccggccctcaccggcaccacggcgtcaaacaatgatctggcatcgctcttcgaatgcccggtgtgtttcgactatgtgctgcctcccattctccagtgccagtccgggcatctcgtgtgttccaactgtcgccccaagctcacctgctgccctacttgccggggaccgcttggttcaatcagaaacctggcgatggaaaaggtggcgaacagcgtgctgttcccgtgtaagtacgcgtcctccggatgcgaaatcactcttccccacacggaaaaggctgatcacgaggaactgtgcgagttccggccatactcgtgcccgtgcccgggcgcatcttgcaagtggcaaggttcacttgacgcggtcatgcctcacctcatgcatcaacacaaatccatcaccacgctgcagggagaggatatcgtctttctggcgactgacataaatctgccgggggctgtcgactgggtcatgatgcaatcctgcttcggcttccacttcatgctggttctggagaaacaggagaaatacgatgggcatcagcagttttttgcgatcgtgcaactgatcggaactcggaagcaggcggagaattttgcctaccgcctggagttgaatggacaccggcgccgcctgacgtgggaagccaccccaaggtctatacatgaaggaattgcaactgccatcatgaactcggactgtctggtgttcgacacttcaatcgcccaattgttcgccgaaaacggtaaccttggaatcaatgtgaccatctcgatgtgc

SEQ ID NO: 33681 - DNA, 846 bp, Artificial Sequence
  Description of Artificial Sequence: Synthetic coding sequence
atgtctagacagaccgctacggcgctgccaaccggaacaagcaagtgtccgccaagtcagagggtgccggcgctcacaggaactactgcaagcaacaatgacctggcctcactgttcgagtgcccggtatgcttcgactacgtactgcctccgattcttcagtgtcagtctggtcacctggtatgtagcaactgtcggccgaagctgacttgttgtccgacctgcagagggcccctgggctctataagaaatttggccatggagaaggtggcgaactcagtgctttttccctgtaaatatgcttccagcgggtgcgagattaccctgccccacacggagaaggctgaccacgaagagctgtgcgaattcaggccgtactcctgtccttgtccaggagcctcctgcaaatggcaaggctcccttgatgctgtaatgccacacctgatgcaccagcataagtcaatcaccaccctgcagggcgaggatattgtgtttctggccactgacatcaatctgcctggggcggttgactgggtgatgatgcagagttgctttggctttcatttcatgctggtcttggagaagcaggaaaagtacgatggacaccagcagttttttgcaattgttcagttgatcggaactaggaaacaggctgagaactttgcctatcgactggaactgaatggtcatcgccggcgcctgacctgggaagccactcctaggtcaatccacgaaggaatagccacagctattatgaatagcgactgtctggtatttgatacctctattgcacagctgttcgctgagaatggaaacctggggattaacgtcaccatcagtatgtgt

SEQ ID NO: 33682 - DNA, 846 bp, Artificial Sequence
  Description of Artificial Sequence: Synthetic coding sequence
atgtcacggcaaactgccaccgcactgcctacgggtacaagcaagtgtccaccttctcagcgcgttccagcactgactggaacgacagcttccaataacgacctcgcttcactttttgaatgtccagtttgcttcgactacgtcctgcctccgattttacaatgccagagtgggcatctggtctgctctaactgcagacccaagctcacctgttgtcctacctgtcgcggaccactgggtagcatcaggaacctcgctatggagaaagtggcgaactcagttttgtttccctgcaaatacgccagcagtgggtgcgaaataaccctcccccataccgagaaagcggaccatgaggagctgtgtgagttccgcccttacagctgtccgtgcccaggcgccagctgtaagtggcaagggagcctagatgccgtcatgcctcatcttatgcaccagcacaaatcaataacgacactgcagggagaggatatagtattcctagctacggacattaatttgcctggagccgtggactgggtgatgatgcagtcctgttttgggtttcacttcatgttagtcttggagaagcaggaaaagtatgacggtcatcagcaatttttcgctatcgttcagctgatcggaacccggaagcaggcagagaatttcgcttatcggctcgagctgaatggccaccgcaggcgattgacctgggaggcgacacctcggtccatccacgaaggcatcgcaaccgccatcatgaattctgactgcctggtgtttgacacaagtatagcacagctatttgctgagaacggcaaccttggcatcaacgtaacgatctcaatgtgc

SEQ ID NO: 33683 - DNA, 846 bp, Artificial Sequence
  Description of Artificial Sequence: Synthetic coding sequence
atgtcgcgccagactgcgactgccctgccgactggcacttcaaagtgcccacctagccagagggttccggcgctcaccgggaccactgcctccaacaacgacctcgcctccttgtttgagtgtcccgtgtgcttcgactatgtcctcccgcccattctgcagtgccagtcagggcacttggtgtgtagcaattgccggccgaagctgacctgctgcccgacctgccgcgggccactcggttcgattagaaatctggcgatggagaaggtcgctaacagcgtgctgttcccttgcaagtacgcttccagcggatgtgaaatcaccctgccgcacactgaaaaagccgaccacgaggaattgtgcgagttccggccgtacagctgcccttgcccgggagccagctgcaaatggcaggggagtttggatgctgttatgccgcacctgatgcatcaacataaatccatcactaccctccaaggtgaggacatcgtgtttctcgccactgatatcaacttgcctggcgccgtggactgggtcatgatgcagtcgtgtttcggattccatttcatgttggtgctggaaaagcaggagaagtatgatggacaccaacagttctttgcaatcgtgcaactcatcggaacccgtaagcaggctgaaaacttcgcctacagactggagctcaacggacaccgcagacggctcacttgggaggccactccgcgctcaatacacgagggcatcgcaacggcgatcatgaactccgactgccttgtgttcgatacttccatcgcacagctctttgcggaaaacggcaacctgggaatcaatgtcaccatcagcatgtgc

SEQ ID NO: 33684 - DNA, 846 bp, Artificial Sequence
  Description of Artificial Sequence: Synthetic coding sequence
atgtctcgccagactgcaactgcactgcctaccggcaccagcaagtgcccacctagccagagggtccccgcacttactggaaccactgcgagcaataacgacttggcgtccctctttgagtgtcctgtctgttttgattatgtgctgcctcctatccttcaatgtcagtccggacacctcgtgtgttccaattgtcgtcctaaactgacctgctgccctacctgtcgcggcccgctgggaagcatcagaaacctggctatggaaaaagtggccaacagcgtgctgtttccatgtaaatacgcatcctcaggctgcgagatcactctccctcacactgaaaaagccgaccatgaggaactctgtgaatttcgcccatactcctgtccttgtccaggggccagctgcaaatggcagggatctctcgacgcagtgatgccacatctcatgcatcaacataagtcgatcactacccttcaaggcgaagatatcgtgttcctcgcaacggatatcaacctgccaggggccgtggattgggtgatgatgcaatcctgtttcggctttcatttcatgctcgtgcttgaaaagcaagaaaagtacgatggccaccagcagttttttgcaattgtccagctgatcggaaccagaaagcaagcggagaattttgcataccgacttgaacttaacggtcacagacgacgcctgacctgggaagcaacgcctcggtcgattcacgaaggcatcgcaaccgcaatcatgaactcggattgtctcgtgttcgatacgtcgattgctcaactgtttgccgaaaatggaaacttgggcataaacgtcaccatttcaatgtgt

SEQ ID NO: 33685 - DNA, 846 bp, Artificial Sequence
  Description of Artificial Sequence: Synthetic coding sequence
atgtcgagacaaactgccaccgctctgcctactggaacctccaagtgcccaccatcacagcgggtgcctgctctgacggggactaccgcatcaaacaatgacctggccagcctgttcgaatgcccggtttgttttgattacgtcttgcctccaatccttcaatgtcaatcaggccatctggtctgttcgaattgtaggccaaagctcacctgctgccctacctgccgcggtcccctgggtagcattcggaacttggctatggagaaagtcgcaaactccgtccttttcccttgtaagtatgcctcgagcggatgcgaaattactctgccgcataccgagaaggcagatcacgaggaactgtgcgagtttcggccttactcctgtccctgtcccggagcctcgtgtaagtggcagggatcccttgacgccgtgatgccacacctgatgcaccaacataaaagcataaccacgcttcaaggtgaagatattgtctttctcgcgaccgatatcaatctccctggagctgtggactgggtgatgatgcaatcatgctttggtttccacttcatgttggtgctcgagaagcaggaaaagtacgacggtcatcaacagttcttcgctattgtgcaactcatcggtacccgcaagcaggcagaaaactttgcataccgactcgaactgaatggtcatcgtcgcaggcttacgtgggaagccacgcccaggtcgatccatgaaggcatagcaaccgcaatcatgaactcggactgtttggtgttcgatacttctattgctcagctttttgccgaaaacggcaatcttggcattaacgtgactatatccatgtgt

SEQ ID NO: 33686 - DNA, 846 bp, Artificial Sequence
  Description of Artificial Sequence: Synthetic coding sequence
atgagcagacaaaccgcaactgccctcccgaccggaacttcgaagtgcccaccgtcacaacgcgtgccggccctcactggcactactgcaagcaataatgacctcgcatccctgttcgagtgtccggtgtgctttgactacgtcctgccgccaatcctgcagtgccagtcaggtcacctggtgtgctctaactgcaggccaaagctgacttgttgcccaacgtgtagaggccccctgggatcgatccggaacctggccatggagaaggttgccaacagcgtgctgtttccgtgtaaatacgccagctcgggatgcgaaatcactctcccgcacactgaaaaagcggatcatgaagagctctgcgagttccgtccttactcgtgcccctgtccgggcgcttcatgcaaatggcagggaagcctcgatgccgtgatgcctcatcttatgcatcaacacaaatcaatcactaccctccagggagaggatatcgtgtttctcgcaaccgacatcaatctgccgggtgccgtcgactgggtcatgatgcagtcttgcttcggattccatttcatgcttgtgctggaaaagcaagaaaagtacgacggacatcagcagtttttcgccatcgtgcaactgatcggaaccagaaaacaagccgagaacttcgcctatcgcctggaattgaatgggcatcggcgaagattgacctgggaagcaactccacgctccatccacgaaggaatcgccactgccatcatgaacagcgactgcctcgtctttgacacgtccatcgcccagctttttgctgagaacggaaacctgggcataaatgtgaccatctccatgtgc

SEQ ID NO: 33687 - DNA, 846 bp, Artificial Sequence
  Description of Artificial Sequence: Synthetic coding sequence
atgtcccgtcaaaccgcgacagccctgcctactggaacgagtaagtgtcccccctcacaaagagttcctgcgctgacgggaacaactgcctccaataacgatctcgcatccctgtttgagtgtcctgtatgcttcgactatgtgctgcccccaattctccagtgtcagtcgggccatctcgtctgttcgaattgcagacctaaactgacatgttgtcctacctgccggggcccattgggttcaatccgtaatctcgcgatggagaaggttgcaaattcagtactgtttccatgcaagtatgcttcatccggctgcgagatcactctcccccatactgaaaaagcggaccatgaggaactgtgtgaattccggccatactcatgcccctgtccaggcgcctcctgtaagtggcaagggtcactggatgccgtgatgccccacttaatgcaccagcacaaatctatcacaactctccagggcgaagacatcgtctttctggccacagatataaatctacccggggcagttgattgggttatgatgcaatcctgttttggcttccattttatgctggtactggagaagcaagagaagtatgatggtcatcaacagttctttgccattgtgcaactaataggtaccaggaaacaagctgaaaacttcgcctatcgcctagagttgaacggacatcggcgcaggctcacttgggaagcaacacctcggagtattcacgagggcattgcaacagctatcatgaactccgactgcctggtgttcgacacgtcgattgcacagctgtttgccgagaacggaaacttaggcattaacgtgaccatttccatgtgt

SEQ ID NO: 33688 - DNA, 846 bp, Artificial Sequence
  Description of Artificial Sequence: Synthetic coding sequence
atgagcagacagaccgccactgccctccccacaggcacatccaaatgcccccctagtcagcgggttccggccctgaccggaactaccgcgtcaaataacgacctggcttctttgtttgaatgtcctgtgtgctttgattacgtgttgccccctatcctgcagtgccagagtgggcatctagtttgctccaactgccgcccaaaactgacctgctgtcctacctgccgtgggccccttggatcgatacggaatcttgcgatggagaaagtggctaacagtgttttgtttccttgcaagtatgcctcaagtgggtgtgaaatcacactgccccacacggagaaagctgatcacgaggaactgtgtgagttccggccgtacagttgcccatgtccaggagccagctgcaagtggcagggaagtttggatgctgtgatgcctcatcttatgcatcaacataagtccattaccactctccagggggaggacatcgtgtttctggcaactgacattaatctccccggagccgtcgattgggtcatgatgcaaagctgttttggcttccacttcatgctcgttttggaaaaacaggagaagtatgatgggcaccaacagttctttgcgatagtgcagctgataggaactcgcaagcaagctgagaattttgcctacagattggaactgaatggacaccggcgtcgcctgacctgggaggcaaccccccggagcattcatgagggtatcgcaactgcaattatgaattcggactgtcttgtgttcgacacatcaatcgcacagctattcgctgagaacgggaatctaggaattaatgtgacaatcagtatgtgc

SEQ ID NO: 33689 - DNA, 846 bp, Artificial Sequence
  Description of Artificial Sequence: Synthetic coding sequence
atgtcgcgccagacggcaaccgcactccccaccggtacgtccaagtgccccccttcgcagagggtcccggcgctgactggaactaccgcctcgaacaatgatctggcctcactcttcgaatgccctgtgtgcttcgactatgtgttgcctccgattctccagtgccagtccggacacctggtctgttcaaattgccggccgaagctcacttgctgcccaacctgccgcggccctctgggatcgatcagaaatctcgctatggaaaaagtggcgaactccgtgctcttcccgtgcaagtacgcctcctcgggttgcgaaatcaccctgccacatactgaaaaggcggaccacgaagaactttgcgaattccgcccttacagctgcccatgcccgggagcgtcgtgcaaatggcagggctcattggatgccgtgatgccgcacctgatgcaccaacataagtcgatcaccactctccagggcgaggacattgtgttcctggccactgatatcaacctccctggagccgtggattgggtgatgatgcagtcctgcttcggattccacttcatgttggttctggaaaaacaggagaaatacgatggacatcagcagttcttcgcgatcgtccaactgatcggcacccggaagcaagccgagaattttgcctaccggctcgagctcaatggccaccgcaggcgcctgacctgggaggctacgccacgctccattcacgaggggattgctactgccatcatgaatagcgattgcctggtgttcgatacttccattgcccaactgttcgcagaaaacggaaacctggggataaatgtgaccatctcgatgtgt

SEQ ID NO: 33690 - DNA, 846 bp, Artificial Sequence
  Description of Artificial Sequence: Synthetic coding sequence
atgagcagacagactgccaccgctttaccgacgggtacgagtaagtgtccaccctcacagagagttcctgcgttaactggtactactgccagcaacaacgacttagcaagtttgttcgaatgcccagtttgcttcgattacgttctccctcctatcctccaatgtcagagtgggcatttggtctgttcgaactgccgccccaaattgacttgctgccctacctgtaggggtccactgggttcaattaggaatcttgcgatggaaaaagttgctaatagcgtcttgttcccttgcaaatatgcttcgtcgggttgcgagattacactgccgcataccgaaaaggctgatcacgaggagttgtgcgaattcaggccgtattcttgtccatgtcctggagcctcttgcaagtggcagggttctcttgatgctgtgatgcctcatttgatgcatcaacacaagagtattacaacccttcaaggagaagatattgttttccttgcaactgatattaatttgcccggcgctgtggattgggtcatgatgcaaagttgctttggctttcactttatgttagttctcgaaaaacaagagaagtatgatggccatcagcagttcttcgcaatagtccagttgattggtaccagaaagcaagctgagaactttgcttatcgacttgagttgaatggtcatagaaggcggttgacatgggaggcaacccctaggtctattcatgagggaatagctactgcgattatgaactccgattgtctcgttttcgatactagtattgcacaactattcgcggaaaacgggaacctggggattaatgtgaccatctcaatgtgc

SEQ ID NO: 33691 - DNA, 846 bp, Artificial Sequence
  Description of Artificial Sequence: Synthetic coding sequence
atgtcacgtcaaaccgctaccgccctgccgactgggacctccaagtgcccaccatcacagcgcgttcctgcattgactggtacgaccgcgagtaacaatgacttggcgtcgctgttcgaatgcccggtgtgttttgattatgtcctgccgcctattctgcagtgccaatcgggtcatctggtgtgttccaattgtcgaccaaaattgacctgttgccccacctgccggggccctcttggttccattcgcaacctggcgatggagaaagtggcaaactccgtgctctttccatgcaagtacgcatcctcaggttgtgaaatcactcttcctcatactgaaaaggcagatcatgaggaactgtgtgagttccggccatactcgtgcccttgtcccggggcatcttgtaaatggcaggggagccttgatgctgtgatgccacatctcatgcatcaacacaagagcatcaccactttgcaaggcgaggacattgtctttcttgcaacggacataaaccttcctggcgcggtcgattgggtcatgatgcagtcatgcttcggatttcactttatgttggtgcttgaaaagcaggaaaagtacgacggacaccaacaattcttcgccatagtccaactcattggaactcgaaagcaggcagaaaactttgcataccgcctggaactgaacggtcaccgacggcgtctcacctgggaggccacccctaggtccattcatgaggggatagcgaccgcaatcatgaattccgattgcctggtgtttgatacctcaattgcacagctgtttgctgaaaatgggaacctgggtataaacgtgaccatttcgatgtgt

SEQ ID NO: 33692 - DNA, 846 bp, Artificial Sequence
  Description of Artificial Sequence: Synthetic coding sequence
atgtccaggcaaaccgccacggctctccccacagggactagtaagtgcccccctagccagagggtccccgctctgactggaaccacagcatcaaacaatgatctggcgtccttgtttgaatgccccgtgtgctttgactacgtcctcccccccattctgcagtgtcaatcaggacaccttgtgtgttcaaactgtcggcctaagctgacttgctgtccgacctgtagaggccctctcggcagcattcggaatctggctatggaaaaagttgctaactcagtgctttttccgtgtaaatacgcctcttccggctgtgagatcaccctgcctcataccgagaaagccgaccacgaggagctgtgtgagttcagaccgtactcctgcccctgtcccggcgcctcctgtaagtggcaaggctctcttgacgcggtcatgccgcatctgatgcaccaacataagagtataacaacgctgcaaggcgaagatattgttttcctcgccaccgatatcaacttgccaggtgctgtggactgggttatgatgcagtcatgttttggattccatttcatgttggtgcttgaaaagcaggagaagtacgacggccaccaacagtttttcgccattgtccaactgatcggcacccggaagcaggctgaaaattttgcttaccgcctggagctcaatggtcataggcgcaggctgacttgggaggccacaccgcggtctatccacgagggtatagccacagcaatcatgaattctgactgtcttgtctttgacactagtatcgctcaactgttcgccgaaaatggtaacttgggtattaacgtgaccattagcatgtgc

SEQ ID NO: 33693 - DNA, 846 bp, Artificial Sequence
  Description of Artificial Sequence: Synthetic coding sequence
atgtcgcggcagactgcgactgccctgccaaccggtacttctaagtgtccgccctcccagcgggtccctgctctgaccggaaccactgcctcgaacaacgaccttgcttcgctctttgagtgtcctgtgtgttttgattacgtgcttccaccaattctccagtgtcagtcggggcatcttgtgtgtagcaactgtcgccccaagttgacttgctgtcctacctgccgcggtcctcttggatcgattcggaacctcgcaatggagaaggtggcaaattccgtcctgtttccgtgcaagtatgcaagctcgggatgtgagattaccctccctcataccgaaaaagcggatcatgaagagctgtgcgaatttagaccttacagctgtccttgtccaggagcctcgtgtaaatggcaaggttcacttgatgccgttatgccccacttgatgcaccaacataaatcgatcaccaccctccagggcgaggatatcgtgttcctggctaccgatatcaacctgccaggcgcagtggactgggtgatgatgcaatcatgcttcggattccatttcatgctcgtcctggagaaacaagaaaagtacgatggtcatcaacaattctttgcaattgtgcagctcataggaacgcgcaagcaggcagagaactttgcgtatagattggaattgaatggacatagaaggcggctgacttgggaagcaactcctagaagcattcatgagggcatcgccacggcgattatgaactcagattgtctcgtgttcgatacctccattgctcagctgttcgcggaaaatggcaatcttggaattaacgtgaccatctccatgtgc

SEQ ID NO: 33694 - DNA, 846 bp, Artificial Sequence; identical to SEQ ID NO: 33638
  Description of Artificial Sequence: Synthetic coding sequence

SEQ ID NO: 33695 - DNA, 846 bp, Artificial Sequence
  Description of Artificial Sequence: Synthetic coding sequence
atgagtcgacaaacagctactgcacttccaacaggtacaagtaaatgtccaccatctcaaagagtaccagctttaacaggaactacagcatcaaataatgatcttgctagtttattcgaatgtccagtttgttttgattatgttcttcctcctattttacaatgtcaatctggtcatcttgtttgttccaactgtagaccaaaattaacatgttgtcctacatgtcgtggaccacttggttcaataagaaatttagctatggaaaaagttgctaattctgttctttttccttgtaaatatgcttctagtggatgtgaaattactcttccacatacagaaaaggctgaccatgaagaattatgtgaattcagaccatatagttgtccatgtccaggagctagttgtaaatggcaaggatctttggacgctgtaatgcctcacttaatgcatcaacacaaaagtataactacattacaaggagaagatattgtattcttagcaacagatataaacttaccaggtgctgtagattgggtaatgatgcaatcatgttttggttttcattttatgttagttttggaaaaacaagaaaaatatgatggtcatcaacaattctttgcaattgtacagttaattggaacacgtaagcaagcagaaaattttgcatacagattagaattaaatggacacagaagaagattaacatgggaagcaacacctagatcaattcatgaaggaatagcaacagctattatgaatagtgattgccttgtttttgatacatcaattgctcaattatttgctgaaaatggtaatttaggaattaatgttacaatttcaatgtgt

SEQ ID NO: 33696 - DNA, 846 bp, Artificial Sequence
  Description of Artificial Sequence: Synthetic coding sequence
atgagccgccaaaccgcaaccgcactccctaccggaaccagcaaatgcccaccaagccaacgggtgccagccctgaccggcacgaccgcatccaacaatgatctcgcctcgctctttgaatgccccgtctgttttgattacgtgctgccacctattcttcagtgtcagagcggtcatctggtgtgttcaaactgccggcccaagctgacctgctgtcccacctgccgcggtcctctgggatcaatacggaatcttgccatggagaaggtggcgaattctgtgctctttccctgtaagtacgcaagctccggatgtgagattactctgccccacacggagaaggctgaccacgaggaactttgtgaattcagaccgtactcctgcccctgtccgggagcttcatgtaagtggcaggggtcccttgatgccgtgatgccacaccttatgcaccagcataagtcgattactacccttcagggtgaggacattgttttcctcgctactgatatcaatctcccaggcgccgtggattgggtgatgatgcagtcctgttttggatttcatttcatgctggtgctggaaaagcaagagaaatatgacggacatcaacagttttttgcgatcgtccagctcataggcaccaggaagcaggcagagaactttgcttacagactcgagttgaatggacataggagacggctgacttgggaagcgacgcctcgatctatccacgagggcattgccaccgctatcatgaactcggattgtcttgtctttgataccagcatagcacagctgttcgcagaaaatgggaaccttggaatcaatgtgaccatttcaatgtgt

SEQ ID NO: 33697 - DNA, 846 bp, Artificial Sequence
  Description of Artificial Sequence: Synthetic coding sequence
atgagtaggcagactgcgaccgctcttcctaccggtacttccaaatgccctccgagccaacgcgtccctgcactcactgggactacggcatcgaacaacgatctcgcgagcctctttgaatgtccagtctgttttgattacgttctgccacccatcttgcaatgtcaatccggacacctggtctgttcgaattgcagaccaaagctgacctgttgtccaacctgcagaggacctttgggctccattcgcaacttggctatggagaaggtggctaacagcgtgctgttcccgtgcaagtacgcctcgtctggatgtgaaatcacgctccctcataccgaaaaggccgaccacgaggaactgtgtgaatttagaccgtatagctgtccctgtccaggggcatcatgcaaatggcagggttcccttgatgccgtgatgccccatctcatgcatcaacacaagagtattactacgctccaaggtgaggacattgttttcctggcaaccgacatcaatctgcctggtgcagtggactgggtgatgatgcagtcgtgcttcggtttccatttcatgcttgttctcgaaaaacaggagaagtacgatggacaccagcaattctttgctatcgtccagcttataggaacgcggaagcaagccgagaattttgcgtaccgactggagctgaatggacatagaaggcggctgacttgggaggctaccccgagatcgattcatgaaggcattgcaaccgccattatgaactcggactgtcttgtctttgatacctcaatcgcccagctgttcgcggaaaacggcaaccttggaatcaatgtgactattagcatgtgt

SEQ ID NO: 33698 - DNA, 846 bp, Artificial Sequence
  Description of Artificial Sequence: Synthetic coding sequence
atgtcacggcagactgcgaccgccttgccgacgggaacttcaaagtgcccgccgtcccagcgcgtccccgccctcaccgggactaccgcctccaacaatgacttggcctcgctctttgaatgtccagtgtgtttcgactacgtgcttcctcctatcctccagtgccaatccggtcatctggtgtgctcgaattgtcgcccgaagctcacttgctgccctacctgcagaggtccactgggatccatccgtaatttggctatggaaaaagtcgcaaactccgtgcttttcccatgtaagtacgcgtccagcggatgcgagatcactctcccacacacggagaaggcggaccacgaagagctctgcgaatttcggccttactcctgcccttgtccaggcgcttcttgcaagtggcaaggatcgctcgatgcggtgatgccgcacctgatgcaccaacacaagtcgattactaccctccagggagaagatattgttttcctggcaaccgatatcaacctgccgggggctgtggactgggtcatgatgcagtcctgtttcggattccacttcatgctcgtgctggagaagcaggaaaagtacgatggacaccaacagttctttgcaatcgtgcagctgatcggaacccgcaagcaggcagaaaacttcgcgtaccggctggagctgaatggccataggagacgcctgacctgggaggctaccccacgcagcatccacgaggggatcgccaccgcaatcatgaacagcgactgtcttgtgtttgataccagcatcgcacagctcttcgcggaaaatggaaacctgggaattaacgtgactatctcgatgtgc

SEQ ID NO: 33699 - DNA, 846 bp, Artificial Sequence
  Description of Artificial Sequence: Synthetic coding sequence
atgagccggcaaactgctaccgctctccctaccggaacctccaagtgtccaccatcacagcgcgttcctgcactgaccggcaccaccgcctcgaacaatgatctggcatcactgtttgaatgtcctgtgtgcttcgactacgtgctgcctccgattctgcaatgccagtccggacatctggtgtgttctaattgcagaccaaaactgacgtgttgtccaacttgcagaggcccgctgggctcgatccgcaaccttgcgatggaaaaggtcgccaattccgtgctttttccttgtaagtacgcgtcgtccggatgtgaaattacccttcctcatactgaaaaggctgatcacgaagagctttgcgaatttcgtccttattcctgtccctgcccgggggcgtcgtgtaagtggcagggatccctcgacgcagtcatgcctcatctgatgcatcaacataaaagcatcacgacgctccaaggggaggacatcgtgttcctcgctaccgacattaatctgcccggagctgttgattgggttatgatgcaaagctgtttcggatttcacttcatgctcgtgcttgaaaaacaggagaagtacgatggacaccaacagttttttgcaattgtgcaactcattggaactaggaagcaggccgaaaacttcgcataccgattggagcttaacgggcataggagacgtcttacttgggaggcaactccacggagcattcatgaaggaatagccaccgcaattatgaactccgattgtctggtgtttgatacctcaatcgcccagcttttcgctgaaaatggcaacctgggtattaacgtgactattagcatgtgt

SEQ ID NO: 33700 - DNA, 846 bp, Artificial Sequence
  Description of Artificial Sequence: Synthetic coding sequence
atgtctcggcaaacagctaccgccctgcctaccggtacaagcaaatgcccgccgagtcagcgggtaccagcgcttacaggcacaacagcaagcaacaacgaccttgcttccctgttcgagtgccctgtttgtttcgattatgtcctgcctccaattctgcagtgtcaatcaggccacctcgtttgttcgaactgcaggcctaaactgacctgctgccctacctgtagaggacccctgggaagtattcgcaatctagccatggagaaggtagccaacagtgtactgttcccttgcaagtatgcatccagcggctgcgagatcacactaccgcacactgagaaggcggaccacgaggaactgtgcgagtttagaccttactcctgcccatgccccggcgcgagttgtaaatggcagggttccctcgatgccgtcatgccccatctaatgcatcagcataaaagtattacaacattgcagggtgaagacatagtcttcttagcaaccgacatcaacctgccaggcgctgtcgactgggtaatgatgcagtcttgtttcgggttccattttatgctggtgctagaaaagcaggagaaatatgatgggcatcagcagttctttgcgattgtacagctcattggaacccggaaacaggccgagaatttcgcataccgcctggagctgaacggacataggcgtcggctgacatgggaggcgacccctagatccatccatgaggggatcgctacagctatcatgaacagcgactgtcttgtctttgacacgagcatagctcagcttttcgccgaaaacggaaatttgggcattaacgtcacaatctctatgtgc

SEQ ID NO: 33701 - DNA, 846 bp, Artificial Sequence
  Description of Artificial Sequence: Synthetic coding sequence
atgagccggcagaccgccactgccctgccaaccggaacaagcaagtgtcctccatcccagagagtgcctgctctgaccggaacaactgcaagcaataatgaccttgcatcactcttcgaatgccctgtgtgctttgactatgtgctgcctcccatcctgcagtgccagtccggccatcttgtatgttcaaattgcaggccgaagctgacttgttgtcctacgtgtcgcggacccctcggaagcattaggaacctagcaatggaaaaggtcgctaatagcgttctttttccgtgtaagtacgctagctccggttgtgaaataactctgccgcacaccgagaaagctgatcacgaggagctatgcgaattcaggccctactcttgcccttgtcctggagcctcatgtaagtggcagggctccttggacgctgtgatgccccaccttatgcaccaacacaagagcatcaccactctgcagggcgaagatatagttttcctcgccaccgacatcaacctccccggtgctgtggactgggtaatgatgcagtcttgcttcggcttccatttcatgctggtcctagagaaacaagaaaaatacgacggacatcagcagtttttcgccattgttcagctcataggaacgcgcaagcaagctgaaaactttgcttataggctcgaattgaatggacatcgcagacgcctcacttgggaagctacaccaaggagtattcacgaaggtattgctaccgccataatgaactccgattgtctggtattcgacacaagcattgcccagttatttgccgagaacggaaatttaggcattaacgtgaccatctccatgtgt

SEQ ID NO: 33702 - DNA, 846 bp, Artificial Sequence
  Description of Artificial Sequence: Synthetic coding sequence
atgagccggcagactgccacagcgctacccacggggaccagcaaatgcccacccagtcagcgcgtgccagctcttacagggacaacagctagcaataatgaccttgcttccttatttgagtgccctgtgtgtttcgactacgtgctgccacctatactgcagtgtcagagtggccaccttgtctgcagtaattgcaggcctaagctgacttgttgccctacctgccgcggacccctcggttccatacggaatctcgcaatggagaaagtcgctaactctgttctctttccctgtaagtatgcttcctccggctgtgaaataactctgccccacacagaaaaggccgaccatgaagaactctgcgaattccgcccctactcctgcccatgtcctggggcctcatgcaaatggcaagggtcactggacgctgtcatgccccacctgatgcaccagcataagagtatcaccacacttcagggagaggatatagtgtttttggccacggacattaatctgcccggcgctgtcgattgggtaatgatgcagagctgcttcggctttcactttatgctcgtccttgagaagcaggagaaatacgatggacaccagcagttttttgctattgtccagctcatcggcacgcgtaagcaggcagagaactttgcctaccgcttggaactaaacgggcaccggcgaagattaacctgggaggccacccccagatctattcacgaaggaatcgctactgccatcatgaactctgactgtttggtatttgatacatcgatcgcgcaactgtttgcggaaaatggcaacctcgggatcaatgttactattagcatgtgt

SEQ ID NO: 33703 - DNA, 846 bp, Artificial Sequence
  Description of Artificial Sequence: Synthetic coding sequence
atgagccgtcagaccgctaccgcattgccaaccgggacttcgaaatgcccaccatcccaacgcgttcctgctctcaccggaaccacggcatccaacaatgatctggcctcgctgtttgaatgtccggtctgttttgactacgtgctcccgcctattttgcaatgccagtccggacatctcgtctgtagcaattgcaggccgaagttgacctgctgccccacctgcaggggtccccttgggtcaattcggaacctggccatggaaaaagtcgcaaacagcgtgcttttcccttgcaagtacgcctcgtccggatgtgagatcaccctgcctcataccgaaaaggcagatcatgaggagctgtgcgaatttcgcccctacagctgcccatgtcccggtgcctcgtgtaaatggcagggatctctcgacgcggtcatgccccatctgatgcatcaacacaaatccattaccactctgcagggagaagatattgtgtttctggccactgacatcaacctgcccggtgcagtcgactgggtgatgatgcaatcgtgcttcgggttccactttatgctggtgctggaaaagcaggagaaatacgatgggcatcagcagtttttcgcaatcgtgcaactcatcggaacccgaaagcaggccgaaaacttcgcctacaggttggaacttaatggacatagacggcggcttacctgggaggcaacgccacgctcaattcacgaggggatagccactgcaattatgaactccgattgtcttgtctttgatacttcaattgcgcagctcttcgcagagaacgggaaccttggtattaacgtgactatttccatgtgt

SEQ ID NO: 33704 - DNA, 846 bp, Artificial Sequence
  Description of Artificial Sequence: Synthetic coding sequence
atgagtcgtcagacggcaacagctctgcccacgggaacatctaagtgtccgcctagccagcgggttccggcacttactggcacgactgcaagcaataatgatcttgcctcactgttcgaatgtccagtctgctttgactatgtattgccaccgattttgcagtgtcagagcggccatttggtttgttcaaactgtcgtccaaaacttacatgctgtccaacgtgccgcggaccgctgggctctatccgcaatcttgcaatggagaaagttgccaatagcgtcttatttccttgcaaatacgccagctctggatgcgaaattaccttgccgcatacggaaaaagccgaccatgaagagttatgtgaatttcgcccatatagttgtccatgtcctggtgcgagctgtaaatggcaaggatctctcgatgctgtcatgccccatttgatgcatcagcacaaaagcattacaacactgcagggagaagatattgtattccttgcgacagacattaatttgccgggagctgttgactgggtcatgatgcaatcatgttttggcttccattttatgttggtcttggaaaagcaggaaaaatatgatgggcaccagcagtttttcgccattgttcaattgattggtactcggaaacaagccgaaaattttgcataccgtctggaactcaatgggcatcggaggcgtttaacgtgggaggccacgccccgctccatccacgaaggtattgcgacagcaattatgaactctgactgtcttgtttttgatacgagtattgcacagctttttgcggaaaatggaaacttaggaattaatgtcacaataagtatgtgc

SEQ ID NO: 33705 - DNA, 846 bp, Artificial Sequence
  Description of Artificial Sequence: Synthetic coding sequence
atgtcccgccagaccgcaactgctctccctaccgggacctccaagtgccccccctcccagcgtgttcccgctctcaccggtacgacggctagcaataacgacctggcatccctgttcgagtgccccgtttgcttcgattatgtgctgccacccattcttcagtgccagtcgggtcatctggtttgttccaactgccggcccaagctcacttgttgtccgacatgccgaggccccttgggatctattaggaatcttgccatggagaaggtggctaactccgttttgttcccctgtaagtacgccagcagcggctgcgagatcactttgcctcacacggagaaggccgaccacgaggagctctgcgagttccgcccgtactcttgcccgtgccccggcgcttcgtgtaagtggcaaggctctttggacgccgtcatgccacacctcatgcaccaacacaaatctatcacgacgctgcagggcgaggacatcgtgttccttgccaccgatatcaacctgccgggtgccgtcgactgggtcatgatgcagagttgcttcgggttccatttcatgctcgtcctcgagaagcaggaaaaatatgacggccaccagcaattcttcgcaattgtccaactgatcggtacacggaagcaagcggagaacttcgcctaccgcctggaattgaacggtcataggcgtcgccttacgtgggaggccacgccccgcagcatccacgagggtatcgccaccgccatcatgaatagcgattgcctcgtcttcgacacgagtatcgctcagcttttcgccgagaacggaaatttgggcattaacgttaccatctccatgtgt

SEQ ID NO: 33706 - DNA, 846 bp, Artificial Sequence
  Description of Artificial Sequence: Synthetic coding sequence
atgtcccggcagaccgccaccgctctgccgacgggaactagcaaatgcccgccgtctcaaagggtaccagccctcaccgggaccactgctagcaacaatgatctcgcctcgctctttgagtgcccagtgtgtttcgactacgtcctgccgcctattctccagtgccaaagcggtcaccttgtgtgctcgaattgccggccgaagctgacctgttgcccgacttgcaggggccctttgggatcgattcggaacctcgcgatggagaaggtcgcgaacagcgtgctgttcccctgcaagtacgcatcatccggctgcgaaatcactttgccacataccgagaaagctgaccacgaagagctgtgcgaattccgtccatacagctgcccatgtcctggagctagctgcaagtggcagggtagcctggacgcagttatgccgcatctgatgcaccagcataagtcgatcaccactctccagggagaggatatcgtgtttctggcaaccgacatcaacctcccaggggcagtcgactgggtgatgatgcaatcctgcttcggattccactttatgctcgtgctggaaaagcaagaaaagtacgatggacatcaacagtttttcgcgattgtgcagcttatcggaacccggaaacaggccgaaaactttgcctacagattggaattgaacggacataggcgtcgactgacctgggaggcgactccgagatcgatccacgaaggcatcgccactgcaataatgaatagtgactgtctggtgttcgataccagcatcgcccagttgttcgccgagaatgggaacctcggtatcaatgtcaccatctccatgtgt

SEQ ID NO: 33707 - DNA, 846 bp, Artificial Sequence
  Description of Artificial Sequence: Synthetic coding sequence
atgagcagacaaacggccaccgctttgccaactgggacatcaaaatgcccgccttcccagagagtgccagccctgaccggtactacagccagcaacaacgatcttgccagtctgtttgaatgtcctgtgtgcttcgactatgtgctcccaccaatcctgcagtgccaatcgggccatctagtttgtagcaactgcagaccaaaactgacttgctgccctacgtgcagaggccctctcgggagcataaggaacctggctatggaaaaagttgctaatagtgtgctgttcccgtgtaagtacgccagctcaggatgcgagataaccctcccacacaccgaaaaagccgaccacgaggagctctgcgaattccggccctactcttgcccttgcccgggagcctcttgcaaatggcaggggtcattagatgcggttatgccccacctcatgcatcagcataagtccattactactctgcaaggcgaagacattgtgttcctcgctacagatataaacctgccgggtgcggtcgattgggtaatgatgcagagctgcttcgggttccatttcatgctcgtgctcgaaaagcaagaaaagtatgacggccatcagcagtttttcgctattgtgcagcttattggaacccgcaagcaggcagagaactttgcttacagattggagctcaatggccatcgcagacgattgacctgggaggccaccccacgttctatccacgagggtatcgccacagccatcatgaactccgattgcctggtgtttgatacttctatcgctcagctgtttgccgagaatggaaatctggggatcaacgtgactatttctatgtgt

SEQ ID NO: 33708 - DNA, 846 bp, Artificial Sequence
  Description of Artificial Sequence: Synthetic coding sequence
atgtccagacagactgcgaccgccctgccgactggaacctcaaagtgcccaccaagccaacgcgtgcccgccctcaccggaaccaccgctagcaacaacgacttggcctccctttttgagtgccctgtgtgcttcgactacgtgctgccaccgatcctccagtgtcagagcggacacctggtgtgctcgaactgccggcctaaattgacttgctgcccgacttgccgggggccactcggcagcatcagaaatctggcaatggaaaaggtcgcgaattcggtgctgtttccgtgcaagtacgcgtctagtgggtgcgagattaccctgccccataccgaaaaggccgatcatgaagaactgtgtgagttcaggccgtactcctgtccatgtccgggagcctcgtgcaagtggcagggatcattggatgccgtcatgccgcaccttatgcaccaacacaaatcaatcacgactctgcagggcgaggatattgtgttcctggccaccgacatcaatcttccgggcgcggtcgactgggtcatgatgcagtcatgctttggattccacttcatgctcgtgctcgagaagcaagaaaagtatgacggacatcagcagttcttcgctatcgtgcagctcatcggtacccgaaaacaagccgaaaacttcgcgtaccgcctggagctgaatgggcatcgccgccggctcacttgggaggcaactcctagatcgatccacgaaggaatcgcaaccgccatcatgaactccgattgtctggtgtttgacacgtccattgcacaactgttcgctgaaaacggcaacctgggtatcaacgttactatctcgatgtgc

SEQ ID NO: 33709 - DNA, 1395 bp, Artificial Sequence
  Description of Artificial Sequence: Synthetic coding sequence
atgggaggagccgttgtcgatgagggccccaccggagtgaaagcccctgacggcggttggggatgggctgttctgttcggctgctttgttatcaccggtttttcctatgccttccccaaagccgtttctgtcttctttaaagaactgattcaagaatttgggattggatatagcgataccgcctggatcagtagtatcctcctggctatgctgtacggaacaggtcctctttgttctgtgtgcgtgaataggtttggatgccggcccgtcatgctagtgggtggcttgtttgctagtctggggatggtggcagcgagtttctgcaggtctatcatacaggtttacctcaccaccggggtgataaccggcctgggcctcgccctgaatttccagcctagtctcataatgctgaataggtacttttccaaaaggcggcccatggctaacggtcttgctgccgccggctctccggtattcctttgtgcgctgagccctctcggacagttgctccaggaccgatatggatggaggggcggtttcttgattctgggcggcttgctcctcaattgctgtgtttgcgccgccttaatgaggccccttgtggtcaccgctcagcctgggtccgggccgcccagaccttcacgtcgactgcttgatctgtctgtgttccgcgataggggctttgtgctttatgcagtcgctgcatccgtgatggtgctgggactttttgtgccgccagtttttgtcgtttcatacgcaaaggatttgggcgtgcctgatacaaaggcagcctttctcctgaccatactgggttttattgacatattcgccaggccagcagccggctttgttgcaggcttgggaaaggtcaggccttacagtgtgtatttgtttagcttctcaatgttcttcaatgggctagccgatttggccggctccacagctggagactacggggggctcgtggtcttttgcatttttttcggaatctcttacggcatggtgggggctttgcagtttgaggtcctcatggctattgtgggcacccacaaattctcctcagcaatagggctggtgctgctaatggaggcagtcgcagtgctagttggcccaccctctgggggcaagcttctggacgcaactcacgtttacatgtatgtgttcatccttgcaggtgcagaagtgctcaccagcagcctgattttgctgctcgggaattttttctgtattaggaagaagcctaaagaaccccagccggaggtggccgctgccgaggaagagaagctgcacaagcctcctgcggacagtggggtggatctgcgagaagtcgaacacttcttaaaggctgagcctgagaagaacggcgaagtggtgcatacgccagagactagcgtt

SEQ ID NO: 33710 - DNA, 1395 bp, Artificial Sequence
  Description of Artificial Sequence: Synthetic coding sequence
atgggcggtgcagtggtggatgagggtccaaccggagtgaaagcacccgacggaggctggggatgggcggttcttttcggatgctttgttattaccggtttcagctatgccttccccaaagcagtcagcgtgttctttaaggaactcattcaggaattcggaatcggttacagcgataccgcatggatttcatccatactcctggcgatgctctacggaacggggccactttgttcagtgtgtgtgaacagatttggctgcagacctgtgatgctggtcggaggccttttcgcatccctgggaatggtggcggcctcgttctgtcgatccatcatccaggtctacctgactaccggagtgattaccgggctgggccttgcacttaacttccagccttcgctcatcatgcttaaccgatacttcagcaagcgacggccaatggccaacggactggcagccgccggatcgcctgtttttctttgtgccctgtcgcccttgggacaactgttgcaagatagatacggatggagaggaggctttcttattcttggtggcctgcttctgaactgttgtgtctgtgcagcacttatgcggcctcttgtcgtgaccgctcaaccaggatctggaccacctcgtccatcccgccgcttgctcgacctgtcggtattcagagatagaggttttgtgctgtacgcggtggccgcttcggtgatggtgcttggtctttttgtgcctcctgtgtttgtagtgtcgtacgcaaaagatctcggggttcctgacactaaggcagcgtttctgctgaccatccttgggtttatcgacatatttgcaagaccagcagccggttttgtggcaggtcttgggaaggtgcgtccttactcggtgtacttgttttcgttttcaatgttcttcaacgggctggccgatcttgcaggctcaactgccggtgattacggcgggctggtcgtgttttgcatcttttttggtatttcgtacgggatggtgggtgcacttcagttcgaagtgctgatggcaattgtcggcacccataagttttccagtgctattggacttgtccttctgatggaagccgtcgcagtgcttgtcggacccccgtcagggggcaaacttctggatgcaactcatgtgtacatgtacgtgttcatccttgcaggagccgaggtcctgacctcgtcgcttatactgctgcttggaaacttcttttgcattcgaaagaagcctaaggagcctcaaccagaggtcgcagccgctgaggaagaaaagttgcataaaccccctgcagattcgggagtggacctcagagaagtcgaacactttttgaaggccgagcctgaaaagaacggagaagtcgtgcacacccctgaaacttcggtg

SEQ ID NO: 33711 - DNA, 1395 bp, Artificial Sequence
  Description of Artificial Sequence: Synthetic coding sequence
atgggtggggccgtggtagatgaaggacctaccggggtgaaggccccggatggtgggtggggatgggcagtgctgtttggttgtttcgtgatcaccggcttttcctatgcctttcccaaggcagtgagcgtgttcttcaaggaacttatacaagaattcggaatcggctactccgacactgcctggatcagctcgatccttctggccatgctgtacggaaccggacctctttgctcggtatgtgtgaaccgatttggctgccgtcctgttatgctcgtggggggcctgttcgcctcccttggtatggtcgcggcctcgttttgtaggtctattatccaagtctacttgactacgggcgtgattactggcctcggtcttgctctgaattttcagccaagccttatcatgctcaacagatacttcagcaagagacgaccaatggctaatggacttgcagcagcaggttcgccagtgttcttgtgtgctctctcccccctgggtcaactgcttcaggacagatacggatggcggggtggctttctgatactgggagggcttcttcttaactgttgcgtctgcgcagcactgatgcgacctcttgtcgtgactgcacaacctggtagcggcccacctagaccttcgcgcagactgctggatttgtcggtgttccgcgatagaggatttgtgctctacgcagtcgccgcatccgttatggtgcttggactgtttgtccctccagtctttgtggtgtcgtatgcgaaggaccttggcgttcccgacacgaaagccgcatttctcctgactattttgggttttatcgacattttcgcacggccagcggctggttttgtggcaggactcggcaaggtccggccgtactcggtctacttgttcagctttagcatgttcttcaatggcctcgcggatctggcgggatccaccgcgggagattacggaggtttggttgtattctgtatcttctttggtatttcatacggaatggtgggagcgctgcaatttgaggtgcttatggcgattgtgggcacccacaaattctcaagcgccattggtcttgtgctcttgatggaagctgtggcggtccttgtcgggcctccatccggaggaaaacttttggatgcaactcatgtgtacatgtatgtgtttattcttgcaggtgccgaggtcctgacgtcaagtctgattctcctccttgggaacttcttttgtatccggaagaagccaaaagaaccccagcccgaggtagcagctgccgaagaagagaaacttcacaagccgccagctgactctggtgtggatctgagggaagtggagcatttcctcaaggcagaacctgaaaagaacggtgaagtcgtgcatacccctgagacttcagtg

SEQ ID NO: 33712 - DNA, 1395 bp, Artificial Sequence
  Description of Artificial Sequence: Synthetic coding sequence
atggggggggctgtcgtagatgagggacctacaggggttaaagcccctgatggagggtgggggtgggcagttcttttcgggtgttttgttataacagggttttcttatgcatttcccaaggcagtaagtgttttcttcaaagaactgatccaggaatttgggatagggtatagtgatactgcatggatttcatccatcctgcttgccatgctctatgggactggaccactgtgttcagtgtgcgtgaatcgtttcgggtgtcgacccgttatgctcgtggggggactcttcgccagtctcggaatggtagccgcctccttttgcaggtccatcatccaggtgtatctgacaacaggagtaatcacagggcttggattggctctaaacttccagccttccttaatcatgcttaatcgatatttttctaaacggcgacccatggctaatggactcgctgctgccggaagtcccgtcttcctctgtgccttgtccccccttgggcagctgctccaggatcggtatggatggagagggggattcttgatcttgggggggcttctgctcaactgctgtgtctgtgctgcgttaatgaggcctcttgtcgtcacggctcagcctggatcagggcctcctagaccttcaaggagactgctcgacctgagtgtattccgggatcgcgggtttgtcctatacgctgtcgcagcttctgttatggttcttggattattcgtaccacctgtctttgttgtctcatacgcaaaggatctgggagtgcctgatactaaagccgctttcctattaactatattgggatttatagacatctttgcacgacccgccgccggattcgtggcaggattgggaaaagtaagaccttactctgtgtatttattctcattctctatgtttttcaatgggctcgctgatcttgccggatcaacagcaggggattatggggggcttgtcgtgttctgtattttcttcggaatctcctacgggatggttggggctctgcagttcgaggtcctcatggcaattgttggaacacacaaattttcatccgccatagggcttgtgctgctgatggaagctgtagccgtattagtggggcccccatctggggggaaactcttagatgccacacacgtctatatgtatgtgtttattctagccggggccgaagtgctcacatctagtctgatcctgctgctggggaacttcttttgtatccgaaagaaaccaaaagaaccacagcctgaagtagccgcggccgaagaggagaaattacataaaccacctgctgactccggagtcgatctccgggaagtggaacattttctgaaagccgaaccagagaaaaacggggaagtcgtgcacactccagaaacatctgta

SEQ ID NO: 33713 - DNA, 1395 bp, Artificial Sequence
  Description of Artificial Sequence: Synthetic coding sequence
atgggcggggccgtggtcgacgagggccccactggggttaaggccccagatggtgggtggggttgggcagtcttatttggatgcttcgtaatcacgggattttcatatgccttcccaaaagcagtgagcgtgttctttaaggaactgatccaggaatttggtatcggctactctgacactgcatggataagctcaattttactcgccatgctgtacgggaccggccctctgtgttctgtatgcgtcaaccggttcgggtgccgacctgttatgctggttggtggactgttcgccagcctgggaatggtggcagcgtccttctgtagatccataattcaggtctacttgaccacaggcgtgataacgggactggggctcgccctgaatttccagccgagtcttatcatgcttaatcgttactttagtaagaggcgcccaatggcaaacggcctggctgccgccggctcccctgtgtttctttgcgcgctcagtcccctgggccagttgctgcaagaccggtatggatggcgcggaggcttcttgatcttgggcggacttctcctgaattgctgtgtctgtgccgccctgatgaggcccttagtggtgactgctcagcccgggagcgggccgccccggcccagtcgcaggttgctggatctatcagtatttagggatagaggctttgtcctgtatgctgtggccgcgagtgtgatggtcctggggttgttcgttccccccgtatttgtggtgagctatgccaaagacctgggcgtaccagataccaaggctgcattcctcttgactatcttaggattcatcgatatctttgctcggcctgctgctggatttgtggcaggcctgggcaaagtgaggccatactctgtctacttgttttcattttccatgttcttcaacggtttggcagacctggccgggagtacagctggtgactacggtggacttgtagtattctgtatttttttcgggattagctacggcatggtgggcgcgctacagtttgaggtgctgatggcgattgtgggaacccacaagttctcctctgccattggattggtgctgttgatggaggccgtggcagtcctggtggggccgccttccggcggcaagttgctcgatgctactcacgtgtacatgtacgtgtttatcctggccggtgccgaggtgttaacatcctccctaatacttttgctagggaatttcttctgcatacggaagaagccgaaagagccccagcccgaggtcgctgccgccgaggaagaaaaactccacaagcctccagctgacagcggagtcgatctaagggaggtcgagcactttctgaaggccgagcctgaaaaaaatggcgaggtggttcatacccccgagacatctgtg

SEQ ID NO: 33714 - DNA, 1395 bp, Artificial Sequence
  Description of Artificial Sequence: Synthetic coding sequence
atgggtggggccgtggtggatgagggacctacgggtgtcaaagctcctgacggaggatgggggtgggccgtattgttcggttgctttgtgatcaccgggttttcgtatgcgtttccgaaagccgtcagcgtattttttaaggaactgatacaagagttcggtattggatactctgataccgcctggattagcagtattctgcttgcgatgctgtacggcactgggcccctttgctcggtatgcgtgaaccgattcggatgccgaccggtgatgttggtcggcggactgttcgcatctctgggaatggtcgctgcatctttctgtaggtccataatacaggtatacctgactaccggagtcatcaccggattaggcttagccctgaactttcagccatctctgattatgcttaaccgctatttctccaaacggcgtcccatggccaatgggctggctgctgcgggctccccggtttttctgtgcgcgttatcccctctcggtcagctgcttcaggacaggtatgggtggcgaggcgggttcctgatactggggggactcttgctgaattgttgtgtctgcgcagccttgatgcgacctcttgtggtaaccgcccagccggggagtgggccgccacggccctcccgcaggcttcttgatctgtccgtgtttagggacagagggttcgttctttatgccgtcgccgcctccgtgatggtcctgggcttatttgtaccgccggtgtttgtggtcagctacgctaaggatttgggagtccctgacacgaaagctgcctttctactgacaattttgggatttattgatatatttgcccggccggcagctggttttgtagccggcctgggaaaggtgaggccgtactccgtatatctgttctctttcagtatgttcttcaatggtctcgcagacttggcaggatcgactgccggggactacgggggcttggtagttttctgtatattcttcggcattagctacgggatggtgggtgccctacaatttgaggttctaatggcaattgttggtacccacaagttcagctctgcaatcgggctggtcctcctcatggaggctgtggctgtcctcgtggggcccccatctggaggcaagctgctggatgccacacacgtgtatatgtacgtgttcatcttggctggagctgaagtgctgacaagttcgctgattctgctgcttggaaatttcttctgcatcaggaagaaaccgaaggaaccccagcccgaagtcgcagctgcggaagaagaaaagctgcacaagcctcctgctgatagtggagttgatttgcgagaggtggaacatttccttaaggcagagcctgagaagaatggggaagttgtccacacccctgagacatcagtt

SEQ ID NO: 33715 - DNA, 1395 bp, Artificial Sequence
  Description of Artificial Sequence: Synthetic coding sequence
atgggaggagcggtggtggacgaagggccgactggagtgaaggctcctgacggagggtggggatgggccgtgctttttggatgcttcgtgatcaccggcttctcatacgcattccccaaggccgtctcagtgttctttaaggaactgatccaagagttcgggattggctactctgatactgcctggatctcctccattctccttgccatgctgtacggaacggggccgctgtgtagcgtgtgcgtgaatagattcggttgccgcccagtgatgctggtgggaggtctgttcgcttcgctcggaatggtcgcggcgtcgttttgccgaagcattatccaagtctacctgaccacgggcgtgattacgggactcggactcgccttgaactttcagccatcgctcatcatgctgaaccggtacttctcgaagcgccgccctatggccaatggcttggcagctgcgggaagcccggttttcttgtgcgcgcttagcccactgggtcaactgctccaagacagatacggttggcgaggaggatttcttatcctcggaggactgctgctcaactgctgcgtctgcgcagcacttatgaggccgctcgtcgtcaccgcacagccgggttcgggaccaccgcgcccctccaggcggctgctggaccttagcgtctttcgggatcgaggtttcgtgctgtacgcggtggccgcgtctgtcatggtgctgggactcttcgtgccaccggtgttcgtggtgtcgtacgctaaggacctgggggtgcctgataccaaagcggccttcctgctgactatcctgggattcatcgacatctttgcgcgcccggccgcggggttcgtggcgggcctcggaaaggttaggccgtactccgtgtatttgttcagcttctccatgtttttcaatgggttggccgacctcgcggggtccaccgcaggcgactacggcgggctggtggtgttttgtatctttttcgggatctcgtacggaatggtgggggccttgcagtttgaggtgctcatggcaatcgtgggcacccacaaattctcgtcagctatcgggctcgtcctgctgatggaggccgtcgcggtcctcgtcggtccacctagcgggggaaaactgctggacgccacgcacgtctacatgtacgttttcatcctggccggagccgaggtgctgacttcttccctgattttgctgctgggaaatttcttctgtattaggaagaagccgaaagagccacagcctgaagtggctgccgccgaagaagagaagctccataagcctcccgcggactccggcgtcgatttgagagaggtggagcacttcctgaaagctgaacccgaaaagaatggagaagtggttcatactccagaaaccagcgtc

SEQ ID NO: 33716 - DNA, 1395 bp, Artificial Sequence
  Description of Artificial Sequence: Synthetic coding sequence
atgggaggagcggtggtcgacgagggacctactggagtcaaggccccggatggaggctggggatgggcagtgctcttcggttgtttcgtgatcactggtttctcttacgccttcccaaaggctgtctccgtgttcttcaaagaactgattcaagagttcggcatcggatactcggacactgcgtggatttcgtccatcctgctcgccatgctgtatggaaccggcccgctttgctcagtctgcgtcaaccgcttcggatgtcgcccagtgatgctcgtgggtggcctgttcgcctcgctcgggatggtggcagcgtcgttctgtaggtcgatcattcaggtgtaccttactaccggggtgatcactggactcggacttgcgctcaatttccagccttctctgatcatgctgaacagatacttctccaagagacgcccaatggctaatggactggccgcggccggatcgcccgtcttcctttgtgcgctgtccccgctgggtcagctcctgcaagatcggtatggatggcgcggaggatttctcatcctgggtggtcttctcctgaactgttgtgtgtgtgcagccctgatgcggcccctcgtggtgaccgctcaacctggatccggaccgcccagacctagccgccgcctcctcgacctgtcggtcttccgagatcgggggttcgtcttgtacgccgtcgctgcgtcggtgatggttctgggcttgtttgtgccgccggtgtttgtcgtgagctacgctaaagatctgggagtgcctgacactaaggccgcattcctgctgactatccttggattcatcgacatcttcgcccggccggcagccggattcgtcgccgggctcggcaaagttcggccatactccgtgtacctgtttagcttttcgatgtttttcaacggcctcgccgacctggctggatcaacggccggtgactacggggggctggtggtgttctgcatctttttcggcatctcatacggtatggtgggagccctgcaattcgaggtgcttatggcgatcgtcggtacccataagttttcaagcgccatcgggctggtgctcctcatggaagctgtggcagtcctggtgggtcccccatccggaggaaaacttcttgatgcaacccacgtgtacatgtacgtgtttatcctggcgggagcggaggtcctcacctcctcccttattctgctcctgggcaatttcttttgcatcagaaaaaagccaaaggagccgcagccagaagtcgctgcggctgaagaagagaagctgcataagcctcccgcggattcgggggtggacctccgtgaggtcgaacacttcctcaaggcggaaccagaaaagaatggcgaagtggttcacaccccggaaacctccgtg

SEQ ID NO: 33717 - DNA, 1395 bp, Artificial Sequence
  Description of Artificial Sequence: Synthetic coding sequence
atggggggagcagtggtggatgaggggcctacaggggttaaagcccccgacggagggtggggatgggccgtgcttttcggttgttttgttatcaccggctttagctacgctttcccaaaagcggttagcgtgttctttaaggaactcatacaggaatttgggattgggtattcagataccgcctggatatcctccatactgctggctatgctctacgggaccgggccactgtgttccgtgtgtgtcaaccggtttggctgtagacccgtcatgcttgttggtgggctgttcgcatcacttggaatggtggccgcgtctttctgccggagcattattcaggtgtatctcacgactggggttattacaggcctcggcttagccctcaatttccagcctagtttaatcatgctgaaccgttacttctcaaagagacgcccgatggccaacggactggctgctgccggtagccccgtcttcctgtgtgcattgagccctctgggccagctgctgcaggaccggtatggatggaggggcgggttccttatattgggcgggctccttctgaattgctgcgtatgcgccgctctcatgagaccactcgtggtaacagctcagcctggctccggcccaccccggccctcacggcggcttctggatctgagcgtgtttagagacagagggttcgtcctgtatgctgtggccgcttctgttatggtgttaggactgtttgtgccccccgtatttgtagtctcctacgccaaagatctaggggtgcctgacaccaaggccgctttcttactcacgattctagggtttatcgacatctttgcaagacctgccgctggattcgtggctggactgggcaaggtccgcccctatagcgtttatctcttcagtttctcaatgttttttaatggcctggccgatctggcaggatcaacggctggagactatgggggcctggtggtcttttgtatcttttttggtatttcttatgggatggttggcgcccttcagtttgaggttctgatggctatcgtgggcacccataagttctcaagcgcaatcggactcgtgctgctaatggaggccgtggccgtcttggtgggcccaccttcggggggcaaattgcttgatgccacgcacgtctacatgtatgtttttatacttgcgggagcggaggtgctcacaagctctttgatactcctactggggaactttttctgtatccgtaaaaaaccgaaagagccccagcctgaagtcgccgcagccgaggaggagaaactgcacaaaccgcctgcagatagcggcgtggacctgagggaagtggaacacttcttgaaggcagaaccagagaagaacggcgaggttgtgcacacaccggagacgtccgta

SEQ ID NO: 33718 - DNA, 1395 bp, Artificial Sequence
  Description of Artificial Sequence: Synthetic coding sequence
atgggtggtgcggttgtagatgaaggtccgacgggtgttaaagcgccggatggtggttggggttgggcggtattatttggttgttttgtaataacgggtttttcgtatgcgtttccgaaagcggtttcggtattttttaaagaattaatacaagaatttggtataggttattcggatacggcgtggatatcgtcgatattactagcgatgttatatggtacgggtccgctatgttcggtatgtgtaaatcgttttggttgtcgtccggttatgttagtaggtggtttatttgcgtcgctaggtatggtagcggcgtcgttttgtcgttcgataatacaagtttatctaacgacgggtgttataacgggtctaggtttagcgctaaattttcaaccgtcgttaataatgttaaatcgttatttttcgaaacgtcgtccgatggcgaatggtctagcggcggcgggttcgccggtatttttatgtgcgctatcgccgctaggtcaattattacaagatcgttatggttggcgtggtggttttttaatactaggtggtttattattaaattgttgtgtatgtgcggcgctaatgcgtccgttagtagtaacggcgcaaccgggttcgggtccgccgcgtccgtcgcgacgtctactagatttatcggtttttcgagatcgtggttttgtattatatgcggtagcggcgtcggttatggtattaggtttatttgtaccgccggtttttgttgtttcgtatgcgaaagatttaggtgtaccggatacgaaagcggcgtttttactaacgatactaggttttatagatatatttgcgcgaccggcggcgggttttgttgcgggtctaggtaaagtacgtccgtattcggtttatctattttcgttttcgatgttttttaatggtttagcggatttagcgggttcgacggcgggtgattatggtggtctagtagttttttgtatattttttggtatatcgtatggtatggttggtgcgctacaatttgaagtactaatggcgatagtaggtacgcataaattttcgtcggcgataggtttagtattattaatggaagcggtagcggtactagtaggtccgccgtcgggtggtaaactactagatgcgacgcatgtatatatgtatgtttttatactagcgggtgcggaagtattaacgtcgtcgttaatactattattaggtaattttttttgtatacgaaaaaaaccgaaagaaccgcaaccggaagtagcggcggcggaagaagaaaaattacataaaccgccggcggattcgggtgtagatctacgagaagttgaacattttttaaaagcggaaccggaaaaaaatggtgaagtagtacatacgccggaaacgtcggta

SEQ ID NO: 33719 - DNA, 1395 bp, Artificial Sequence
  Description of Artificial Sequence: Synthetic coding sequence
atggggggcgctgtggttgacgaaggaccaaccggcgtaaaagctccagacgggggctggggatgggcggtgctcttcggctgctttgtcattaccgggttctcttacgcctttcctaaagccgtctctgtcttcttcaaggaactgattcaggagttcggcattggctatagcgataccgcttggatctcttccatcctgctggcgatgctgtatggaactggacccctttgctcagtgtgcgttaatcgatttggatgtaggccggtaatgctggtcggaggactgttcgcatccctgggcatggtagcagcttccttctgtagatccatcatccaggtctacttaactactggagtcatcaccggcctggggctggctctgaattttcagcccagcctcattatgctaaaccgatactttagcaagcggcggcccatggctaatggactggctgccgcagggagcccggttttcttgtgtgccctctccccgctgggccaactgttgcaagatcggtatgggtggagaggcggatttttaatactcggagggctgctgctgaattgctgcgtgtgcgctgccttgatgcgacctctggtcgtaacggcacagccagggtctggtccacccagacccagtcggcggcttctagacctgagcgtattcagggacaggggatttgtgctgtatgcagtggctgctagcgtgatggtgcttggactctttgtgccccctgtgtttgttgttagttacgcaaaagatttgggcgttccagataccaaggctgcctttctgcttacaatcctgggcttcattgacattttcgctaggcctgccgctggattcgtagcgggccttggaaaggtacgaccatattcagtgtatcttttcagtttcagcatgtttttcaacgggctagccgatctggccggctctactgccggcgattacggcgggttggtggtcttctgcattttctttggcatttcctacgggatggtgggcgccctacagttcgaagtccttatggcgattgtgggaacccataagttttcctcagctatcggtttagtgcttctcatggaagctgtcgcggtgctcgtcggtcctccatccggtgggaagcttttagacgccactcacgtgtatatgtacgtcttcatcctggcaggggcggaagtgctcactagtagcctgatactactgctgggtaattttttttgtattaggaaaaagcccaaggaaccacagcctgaggtagccgcagccgaggaggagaaactccataaaccccctgcagactctggcgtggacctccgcgaagttgaacacttcctcaaagccgagccagaaaaaaacggtgaggtggttcacacccccgagacctccgtt

SEQ ID NO: 33720 - DNA, 1395 bp, Artificial Sequence
  Description of Artificial Sequence: Synthetic coding sequence
atgggcggagcagtggttgacgagggaccaaccggcgtcaaggcgccggacgggggatggggatgggctgtgctgttcggatgctttgtcatcaccggtttttcatacgccttccccaaggcggtcagcgtgttcttcaaagaacttatccaagaatttggcatcggttactcggacactgcatggattagctcgatcttgctggctatgctgtacggcaccggaccactgtgctcggtgtgtgtcaaccgcttcggatgccggccggtcatgctggtcgggggactctttgcgtctttgggcatggtggccgcctcattctgcaggtcaatcatacaggtctacctgaccaccggtgtgatcactggactgggactggcactgaactttcagccgtccctgatcatgctcaataggtacttttccaagcgtagaccaatggcgaacggtctggccgccgcaggctccccggtctttctgtgtgcactgtcgccgctgggacagcttctgcaagatcggtatggttggagaggcgggttcctcattttgggcggactcctgcttaactgctgtgtctgtgctgccttgatgcgcccactggtggtgactgcgcagcctgggtcaggcccacctcgcccatccaggcggctgctggacctgtcggtgttccgcgatcgaggattcgtgctgtatgccgttgcagcctctgtgatggtgttgggattgttcgtgccaccggtctttgtggtttcgtacgccaaagatctgggagtcccagacactaaggcagcattcctcttgaccatcctgggcttcatcgacattttcgcgcgcccagcagcaggtttcgtggcgggtcttggaaaagtccggccctactccgtctacctgttcagcttttctatgttcttcaatggactggccgatctggcgggaagcaccgctggagattacggggggctggtggtgttctgtatcttctttggaatctcctatgggatggtgggtgccctgcaattcgaagtgctcatggccattgtgggcacccataagttttcatcggcgatcgggctcgtcctgctgatggaggccgtggctgtcctggtcggaccgcctagcggcggaaagctgctggatgccacccacgtgtacatgtatgtgttcatcctcgccggcgcagaggtgcttacttcctctctcattctgcttcttggtaacttcttctgcatcagaaagaagccgaaggagccccaaccggaagtcgccgctgccgaggaggagaaactgcacaagccgccggccgactccggagtggatcttagagaggtggagcactttctcaaggcggagccagagaaaaacggagaggtcgtccacaccccagaaacgagcgtg

SEQ ID NO: 33721 - DNA, 1395 bp, Artificial Sequence
  Description of Artificial Sequence: Synthetic coding sequence
atgggtggagctgtcgtcgacgaaggtccaactggggtgaaagcaccagacggaggatgggggtgggcagtgctttttggatgtttcgtgatcactggtttttcatacgcgtttcctaaggcagtgtccgtgtttttcaaggaactcattcaggagtttggaattggatacagcgatactgcctggatctcgtcgattcttctcgccatgctttatggcaccggaccactttgttcggtgtgtgtgaaccgctttggctgtcgacctgtgatgctcgtgggtggactgtttgccagccttggaatggttgccgcctcgttttgtcggtccattattcaggtgtacctgactaccggggtgatcaccggcctgggactggctttgaactttcagccttcgctcattatgcttaaccgttactttagcaagcggcgccccatggcaaatggtctggctgcagccgggtcgccagtgtttctgtgtgcactctcacccctgggtcagctcctgcaagaccgctacggatggcgcgggggtttccttattctcggcggccttctgctgaactgttgtgtgtgcgcagcacttatgaggcctctggtcgtgactgcccaacctggatcgggccctccgcgcccttccaggagacttctggacctcagcgtgtttagagatcgcggtttcgtcctttacgcagtggcagcatcggtgatggtccttgggttgtttgtcccaccagtctttgtcgtgagctacgccaaggacctgggtgtgcctgatactaaggcagcatttctcctcactattctgggattcatcgacatttttgctaggccagcagccggatttgtagcaggactcggcaaagttcgtccatactccgtgtacctgttctcctttagcatgttcttcaatggccttgcggacctggccggctccacggcaggagactacggtggcctggttgtgttttgcatcttttttggaatatcatacggtatggtgggagccctgcaattcgaagtgctgatggcgattgtgggaactcacaagttttcctccgcaatcggtcttgtgctcctcatggaagcagtggccgtcctcgtagggcccccatcaggtggaaaacttctggacgcaacccatgtctacatgtacgtgttcatcctggcaggagcagaagtgcttacctcgtccctgattctcctcctcgggaatttcttttgtatccgaaagaagcctaaagaacctcaacctgaagtggcagccgccgaagaggagaaacttcacaaaccccctgcagattccggagtggaccttcgagaagtggaacatttccttaaggcagaaccggaaaagaacggagaagttgtgcataccccagagactagcgtg

SEQ ID NO: 33722 - DNA, 1395 bp, Artificial Sequence
  Description of Artificial Sequence: Synthetic coding sequence
atggggggtgcagtggtggatgagggcccaacaggtgtgaaggctccagatggaggatgggggtgggccgtcctgtttggctgcttcgtgataaccggattttcatatgccttcccaaaagccgtgtccgttttctttaaagagctgattcaggagttcgggatcgggtattccgacacggcatggatctcctctatcctccttgcaatgctatacggaacgggccccctgtgctccgtctgcgttaataggtttggttgccggcctgtcatgttggtggggggactgttcgcatcacttgggatggtagcggcaagcttctgcaggtcaattatccaggtgtacctgaccaccggcgtgataacagggcttgggctagcacttaattttcagccaagtctgattatgctaaaccgctattttagcaaacgaagacctatggccaatggactggccgctgctggatctcctgtctttctgtgcgccctgagccctctggggcagctgctgcaggaccgttatggatggaggggcggtttcttgatattaggaggactgctgctgaattgttgtgtatgcgctgctctcatgagacctctggtcgtgactgcccaaccaggctctggtccgccaagaccctcgcgccgacttcttgatctgtccgtctttcgggatcgagggtttgtgctctacgctgtcgctgcctccgtaatggtactgggcctcttcgtccctcccgtgtttgtcgtttcttacgccaaggatctcggtgttccagacacaaaggcagctttcctgctgactatcttgggctttatcgacattttcgccagacctgccgctggcttcgtggcgggccttggtaaggtccggccttattctgtttatctattctcattctccatgtttttcaatggccttgccgaccttgccggatccacggcaggagattacggtggcttagtcgttttctgcatcttttttggcattagctatggtatggttggagcccttcagtttgaagttttgatggccatcgtgggaacccacaagttcagttccgccattggacttgtgctcctgatggaggccgtagccgtgctggttggaccccctagcggcggaaagctcctggacgctacccacgtctatatgtatgtattcattcttgccggagctgaagtgttgacctcatctttgatccttcttctgggcaatttcttctgcattaggaagaagccgaaggagcctcaacctgaggtggccgctgcagaggaagagaaattgcataaacccccagcagattctggggtggacctcagggaagtagagcattttctgaaggccgagcccgagaagaatggcgaagtcgttcatacccccgagacttcggtg

SEQ ID NO: 33723 - DNA, 1395 bp, Artificial Sequence
  Description of Artificial Sequence: Synthetic coding sequence
atgggcggggctgtggtcgacgaaggaccaactggcgtgaaagctcctgacggaggatggggttgggccgtgctctttggctgctttgtcataaccgggtttagttacgctttccctaaagctgtcagcgtcttctttaaggagctgatccaggaattcggcatagggtactctgacactgcctggatatcttccatactgctcgctatgctctatgggaccggtccactctgctccgtgtgcgtgaaccgcttcggctgtaggccagttatgctagttggcggcctgttcgcctctttaggcatggtggctgcatctttttgccgatcaattattcaggtgtacttgacaaccggcgttataactggcctgggcctggccctgaatttccaaccaagtctaataatgttaaatcgctacttttccaagagaagacccatggctaacggactggctgccgccgggagccctgtttttttgtgtgccctaagcccactcgggcagctgctgcaggatcgctacggttggcgggggggtttcctgatccttggcggcctgctgctgaactgctgtgtgtgtgctgccttgatgcgccccctggttgtcaccgcccagccaggaagtgggcctccccgtccctccagaaggctgctcgacctgtctgtgttccgtgatcggggctttgttctgtacgccgtggctgctagcgtgatggtgctgggcttgttcgtgccccccgttttcgttgtgagctacgccaaagacctaggggttccagatacaaaggctgccttcttactgaccatcttaggctttattgacatattcgccaggcctgccgccggctttgtggcagggcttgggaaagtccgcccttacagcgtgtatttattttctttctccatgttcttcaatggcctagccgacctggctggatctactgcaggggattatggaggtctcgtggttttttgtatctttttcggcatatcttatggtatggtgggggccttgcagttcgaggtgcttatggcaatcgttggcacacacaaattcagctccgctatcggattggtgcttctgatggaggcagttgccgtgctggtggggccaccctccggcggcaagctgttagatgccacacacgtttacatgtacgtcttcattctcgccggagctgaggtgctgacatcttccctcatcctgttattggggaacttcttctgcataagaaagaagcctaaggagccccaaccagaagtggccgccgccgaggaggaaaagctccacaagccacctgcagatagtggggtggacctgcgcgaagttgaacacttcctgaaagccgaacccgaaaaaaacggcgaggtggtgcatactcccgagaccagcgtc

SEQ ID NO: 33724 - DNA, 1395 bp, Artificial Sequence
  Description of Artificial Sequence: Synthetic coding sequence
atgggcggcgcagtggtcgatgagggtccgacgggtgtgaaggcccccgatggtggatggggctgggccgtgctgttcggctgcttcgtcatcactggattctcgtacgccttccccaaggccgtcagtgttttcttcaaagaactgatccaggaattcggtatcggctactccgacactgcctggatctcctccattctgttggccatgttgtacggtaccggtccattgtgtagtgtctgcgttaaccgcttcggctgccgaccggtgatgctcgtcggcggtcttttcgccagccttggcatggtggccgcctcattctgccgtagcattatacaggtgtacctcaccactggtgtcatcaccggtctgggtcttgctttgaacttccagccttcgttgatcatgttaaaccgctatttttcgaaacgccgccccatggcgaatgggctggcggctgcaggtagtcccgtcttcctttgcgctctgtcgcctcttggtcagctactccaggatcgctatggctggcgcggcgggttcctcattcttgggggtctcctgctgaactgctgcgtgtgcgccgctcttatgcgccccctcgttgtcacggcgcagcctggatccggccctccccgtccttctagacgccttttggacctgtcagtctttcgtgaccgtgggttcgtgctttacgccgtggcggcttccgttatggttctcggtctgttcgtaccgccggtgttcgtcgtttcgtatgccaaggacctcggtgtccccgacaccaaggccgccttcctgttgacaatcctcggtttcatcgatatttttgccaggcccgccgccgggttcgtcgctggcctgggcaaggtgcggccctactcggtctacctcttctccttctctatgttcttcaacggacttgcagatctggcaggcagcacggccggggattatggtgggctcgttgttttctgcatctttttcggcatttcttatggtatggtgggtgctctacagttcgaggtgcttatggccatcgtgggtacccacaagttcagcagtgccattggcttggtcctcttgatggaggctgtcgccgtgcttgtcggaccgccatccggaggaaagcttctcgatgcgacccacgtttatatgtacgtgttcattctggcaggtgcagaagtcttgacgagcagcttgatcctgctgctcggaaacttcttctgcatcaggaagaagcccaaggagccgcaacccgaggttgctgcagctgaggaagagaagctccataagccgcctgccgactccggcgtggacctgcgggaggttgagcatttcttgaaggccgagcccgagaagaacggagaggtcgttcatacaccagagacctcggtc

SEQ ID NO: 33725 - DNA, 1395 bp, Artificial Sequence
  Description of Artificial Sequence: Synthetic coding sequence
atgggtggcgccgtggtggacgagggcccaacaggagtgaaggctccggatgggggctggggatgggccgtcctatttgggtgttttgtaattacaggcttctcgtatgccttcccaaaggcagtgagcgttttttttaaggaactgattcaggagttcggcattggctatagcgacactgcctggatctcttctatcctgttggccatgctatacggaactggccctttatgctccgtctgcgttaacaggttcggttgccgccccgtgatgcttgtgggtgggctgtttgcaagcctgggcatggtcgctgcaagcttttgtaggagcatcatccaggtttatctcaccacgggggtgataacaggtttaggactggccctgaatttccaaccctccttaatcatgttaaaccggtactttagcaagagaagaccaatggctaacgggctggccgcggctggctccccagtgttcctctgtgccctgagcccgctggggcaactcctgcaggacaggtacgggtggcgcggggggttcctcatactgggtggcctcctgctgaactgctgcgtctgcgctgcgctaatgagaccactcgtagtgacagcccagcctggatcaggccctcccagaccatccaggaggcttctggacctgtccgtttttagagacagaggctttgttttgtacgcggtcgcggcaagcgtgatggttctcggactcttcgtcccacctgtgttcgtggtctcctacgcaaaagaccttggcgtcccagacactaaggcagccttcttgttgactatactcggattcattgacatcttcgctcgaccagcagccggctttgtcgccggcttaggaaaggtgagaccatatagcgtgtacttgtttagcttttccatgttctttaatgggttagcggatttggcaggaagtactgctggcgactatgggggtctggtcgttttttgcatcttcttcggaattagttacgggatggtgggggccctccagttcgaggtgctcatggcaatagtcggtacccataagttctcaagcgcaatcggattggtcttactcatggaggccgtggcagtcttagtcggaccgcccagtgggggcaaattgcttgatgctactcatgtttacatgtacgtgttcatcctggccggagcagaagtcctcacctcgagcctaatccttctgcttggtaacttcttctgtatccggaaaaaacctaaggagccccaacccgaggtggccgccgctgaagaagagaaactacataagcctcccgccgatagcggagtcgatctcagagaagtggagcacttcctgaaggctgagcccgaaaaaaacggtgaagtagtccacaccccagagacatctgtg

SEQ ID NO: 33726 - DNA, 1395 bp, Artificial Sequence
  Description of Artificial Sequence: Synthetic coding sequence
atgggaggggcagtggtggatgaaggacctaccggtgtcaaggcgcctgatggaggttggggatgggcagtgctgtttggatgttttgtgattactggatttagctacgccttccccaaggccgtgtcggtattcttcaaagaactgatacaggaatttggtattggatactcggataccgcatggatcagtagcattcttcttgcaatgctctacggaaccggtcccctttgttccgtgtgcgtaaaccgatttggctgtcgccccgtcatgcttgttgggggcttgttcgcatcactggggatggtcgctgcatctttctgtcgatcaattatccaggtctacttgactacgggagtcattaccgggctcggtctggcactcaattttcaaccttcgctgatcatgctcaacagatacttctccaagagacgcccaatggcaaatggccttgcggcggcaggatcccctgtctttctgtgcgccctgtcaccacttggacaactgttgcaagacaggtacggttggagaggtggatttcttatcctcggcgggctcttgctgaactgttgcgtgtgtgcagcactcatgcgtcctctcgttgtcactgcccaaccaggctcagggccacctcggccatcgagacgactccttgatctgtccgtgttccgtgaccggggttttgtgctctacgctgtggcagcatccgtgatggtgctgggtcttttcgtgcctcctgttttcgtggttagttacgccaaagatctgggtgtccctgatactaaggcggcatttctgctcactatcctgggctttatcgacattttcgcacggcccgctgcgggttttgtggccgggttgggtaaggtacgcccatacagcgtctatcttttttcctttagcatgttctttaacggtctggcagatcttgctggttccactgcaggagattacggcggcctggtggtgttttgcatattctttggcatttcgtatgggatggtcggagcactgcaatttgaagtcctcatggcgattgttggaacccacaagttctcgtcagccatcgggctggtgctgctgatggaagcagtggccgtgctggtgggaccgccgagcggaggaaagttgcttgatgccactcacgtgtacatgtacgtgttcattttggcaggagccgaagtccttacctcctcgctcattctgctgcttggtaacttcttttgtatccggaagaaacctaaagaaccacagcccgaggtcgccgcggcggaggaggagaagctccataaaccacccgcggactcgggcgtcgaccttagagaggtggaacattttcttaaggcagaaccagagaagaatggtgaagtggtgcatacccctgaaacgagtgtg

SEQ ID NO: 33727 - DNA, 1395 bp, Artificial Sequence
  Description of Artificial Sequence: Synthetic coding sequence
atgggaggtgccgtggttgacgaaggtccaactggagtgaaagcaccggacggtggctggggatgggccgttctttttggatgtttcgttataaccggattcagttacgcttttccaaaggcagtatcggtgtttttcaaggaactgattcaagaattcggtattggttactccgacactgcatggatctcgagcatcctgttggcaatgctctacggcaccggccccctgtgtagcgtgtgcgtcaatcgatttggttgtcgaccagtgatgctcgttggcggacttttcgcgagccttggtatggtggcagcatccttttgcagaagcatcattcaggtctacctcactactggagtgattacgggactgggtcttgcactcaactttcaaccaagcctgatcatgcttaacaggtacttttcaaagcgacggccgatggcaaacggactcgctgcagccggatcccctgtgttcttgtgcgctctcagcccacttggccagcttcttcaagacagatacggttggcgcggagggtttctcattcttgggggactgctgcttaattgttgcgtctgcgctgcacttatgcggccactggtggtcaccgcccaacctggatcgggccctcctagaccatcgcggagactcctcgatctgtcagtctttagagatcgcgggtttgtcctttacgcggtcgccgcttcggtgatggtgctggggttgtttgtaccgccggtctttgtcgtatcctacgcaaaggatctcggggtgccagacacgaaggcagcctttcttctgactattctgggctttatcgatatctttgcacgccctgcagccggttttgtggcagggctgggtaaggtccggccttattcggtgtacctgtttagcttctcaatgttctttaatggactcgcagaccttgctggaagcactgccggggattacggtggccttgtggtgttttgcatattcttcggtatatcgtatggaatggtgggcgcgctccagtttgaggttttgatggcaattgtgggcacccacaagtttagctcagcaattggactcgtgctgcttatggaagcggtcgctgtcctggtgggtcctccatccggcggtaagctgctcgatgccacccatgtgtatatgtacgtctttattctggcgggtgctgaagtgctgacctcgtcgctgatcctgctcttgggtaactttttctgtattcgcaagaaacctaaagagccccaacctgaggtggcagcagctgaagaagagaagctgcacaaacctccagcagattccggggtggatctgcgtgaagtcgaacattttctgaaggcagagcctgagaaaaacggtgaagtggtgcatactcctgaaacgtccgtg

SEQ ID NO: 33728 - DNA, 1395 bp, Artificial Sequence
  Description of Artificial Sequence: Synthetic coding sequence
atgggtggagcagtggtggacgagggacctaccggagtgaaagcccctgatggcggttggggctgggcagttctctttgggtgttttgtgatcaccgggttctcttacgcatttcccaaggcagtgtcggtctttttcaaggaactgattcaagaatttggaatcggctactcggatactgcgtggatctcgtcaatattgctcgcaatgttgtacggcaccggaccactgtgtagcgtctgtgtgaaccgctttggatgccgccctgttatgctggttgggggtcttttcgcctcgctgggcatggttgccgcgtctttttgcagatcgattatccaagtgtacctcaccaccggagtgatcaccggtttgggactggcactcaatttccagccatcgctcattatgctgaaccggtatttcagcaagagacgaccaatggcaaatggcttggccgcagctggcagccctgtttttctttgtgccctgtcgccattgggacagctgctgcaagatcgttacggatggagaggaggcttcctcatcctgggcggcttgctgcttaattgctgcgtgtgcgctgcacttatgaggccacttgtggtcactgcacaaccaggttccggaccaccccgcccttcccgcagacttctggacctgagcgtctttagggatcggggatttgtcctgtacgcagtggcggccagcgtcatggtccttggcttgttcgtgcccccggtgttcgtcgttagctacgccaaggacctgggagtgcctgataccaaggctgcatttctcctgaccattcttggtttcatcgacattttcgctcgacctgctgcaggttttgtcgcaggccttggaaaagtccgcccatattccgtctacctcttttcgttttccatgtttttcaacgggttggcagatcttgcaggttcgacggcaggtgattacgggggactcgtggtgttttgcatcttctttggcatctcatacggtatggtgggagcgttgcagttcgaagtgctgatggccattgtgggaactcataagttttcatcagcaatcgggcttgtccttctcatggaagcggtggcagtcctggtcgggcctccctccggaggtaagctgctcgacgctactcatgtgtacatgtacgttttcatcctggcaggtgctgaagtgctgacctcgtcgcttattctccttttgggtaacttcttttgtatccgtaagaagcctaaagaaccccagcctgaggtggctgcagcagaagaggaaaagctgcataaaccacctgccgactcgggggtggatttgagagaggtggaacactttctgaaagcggagccggagaaaaacggagaggttgtgcacacgcccgaaaccagtgtg

SEQ ID NO: 33729 - DNA, 1395 bp, Artificial Sequence
  Description of Artificial Sequence: Synthetic coding sequence
atgggaggagccgtcgtcgatgaaggccctactggggtgaaagcgccggacggcggatggggatgggccgtgctgttcggatgtttcgtgatcactggctttagctacgcatttccaaaggccgtgtctgtgttctttaaggagttgatccaggagtttggcatcggatactccgataccgcttggatctcatccatactgctggcaatgctgtatggtacgggaccgctgtgttcggtgtgcgtcaatcggtttggatgtcggcccgtcatgctggtcggtggattgtttgcgagcctgggaatggtcgcggcctcgttctgccgctcgatcatccaagtctacctgactactggtgtgatcaccggactggggctcgcattgaacttccaacccagcctcatcatgctgaaccgctacttctccaaacgccgcccaatggcaaacgggctcgccgccgctggatccccggtctttctctgcgcgctgagtcccctgggtcaactgctccaagaccggtacggatggcgaggtgggttcctcatactgggaggactgctcctgaattgctgtgtgtgcgcagcccttatgaggcccctcgtggtgaccgcacagccgggctcaggaccgccgcgcccgtcgagacggctgcttgacctgtcggtgttccgcgaccggggcttcgtgttgtacgctgtcgctgctagcgtgatggtgctcggactgttcgtgccgccggtgttcgtagtgtcctacgcgaaggatctcggcgtgccggataccaaagcggccttcctcctgaccatcctgggcttcattgatatcttcgcaagacctgccgctgggtttgtggcggggcttggaaaggtgcggccgtacagcgtctacttgttttccttctccatgttcttcaatggcctcgcggacctggccgggtcaaccgccggcgattacggcggcctcgtggtgttctgcatcttttttgggatctcctacggcatggttggagctcttcagttcgaggtgctcatggctatcgtgggtactcacaagtttagcagcgccatcggactggtgttgttgatggaggcagtcgcggtcctcgtgggacctccaagcggaggaaagctcttggacgcgacccacgtctacatgtatgttttcatcctcgccggagcggaggtcctgacctcatccctcatcttgctgctgggtaacttcttctgtatccggaagaagccgaaggaaccacagcctgaggtggcggccgccgaagaggagaaactgcataagccgccggccgattctggggtggacctgcgcgaggtcgagcatttcctgaaagctgaaccggagaagaatggcgaagtggtccacacgccagaaacttcagtg

SEQ ID NO: 33730 - DNA, 1395 bp, Artificial Sequence
  Description of Artificial Sequence: Synthetic coding sequence
atggggggagcagttgtggatgaagggccgactggggtcaaagcacctgacggcggctgggggtgggccgttctgtttggctgcttcgtgatcacaggcttcagctatgcctttccaaaagcagtgtccgttttctttaaagagctcattcaagaatttggcattgggtattcagacacagcatggatttcctccatacttctagctatgctttatggaacggggcccttgtgtagtgtctgcgtgaaccgcttcggctgtcgccccgtgatgctcgtcggcggattattcgccagcctaggtatggtggccgcctctttctgtaggtctatcatccaagtttacctcacaactggagtgattactgggctaggcttggcgctgaacttccagccgtctctaattatgctgaacaggtatttctctaaacgcaggcctatggcaaatggtctggcagccgcagggtctcctgtatttctttgtgccctaagccccctcggtcagttgctgcaagacagatatggctggcggggcggatttctcatcttaggtggactgctccttaattgctgcgtgtgtgcagccctgatgcggcccttagtcgttactgcacagcccggttcaggaccacctcgccctagtaggcgtctactggatctctctgtattccgagatcgcggattcgtgttgtacgccgtggctgcctcagtgatggttctgggactgttcgtgcctcctgtcttcgtcgtgtcctatgccaaagacctcggagtgccagataccaaagctgcgttcctgctgactattttgggatttatagacatctttgcacgcccggctgcaggatttgtggccggactgggaaaggtgagaccatattccgtgtatctgtttagcttcagtatgttttttaacggtttggcagacttagccggctctactgctggagactatgggggcctcgtggtattctgtatttttttcggcatatcctatggcatggtgggagctctgcaatttgaggttctgatggccatcgtaggcactcacaaattcagtagcgctatcggacttgtactgctgatggaggctgtggccgtcctagttggcccaccttccggaggaaagctgttggacgcaacgcacgtctacatgtatgtcttcatcctagccggcgcagaggtgttgacctcaagtcttatcctcctactcggtaatttcttctgtatccgcaagaagcctaaggaacctcagccagaggtggctgctgccgaggaagagaaactacataagccccccgccgattcgggagttgacttgcgagaggtagaacacttcctcaaagcggaacctgaaaagaacggagaggtcgtccataccccagaaacttcagtg

SEQ ID NO: 33731 - DNA, 1395 bp, Artificial Sequence
  Description of Artificial Sequence: Synthetic coding sequence
atggggggcgcggtagtggacgaggggcctaccggagtgaaggcccctgacggaggctggggctgggcagtgctttttgggtgttttgtgattactggcttctcatacgcatttcctaaggcagtgagtgtcttctttaaggagctcattcaggaattcggcattggctattccgataccgcttggatcagcagtattttactcgccatgctgtacggtaccggcccattgtgttctgtgtgtgtcaaccgattcggctgtcgccctgtgatgctggttggtggcttatttgcctccttagggatggttgctgcttctttttgccgctctatcattcaggtctatctgacaaccggagttatcacagggctcggcctcgctttgaattttcagccgtccctgatcatgctcaatcggtacttttctaagaggagacccatggccaatggcttggccgcggctggaagccctgtattcctctgtgccctgtccccactcggacagctgttacaggaccgctacgggtggcggggagggtttctgattttgggtggtttgctcctgaactgctgcgtttgcgcagctctaatgagaccgcttgtggtcacagcacagccgggctccggtccacccagacctagtcgcaggctgctggacctgagtgtgttcagggatcggggttttgttttgtacgccgtagcagcctctgtgatggttttgggtctgttcgttccacccgtcttcgtggtcagttatgcaaaggatctgggggtgcccgacactaaagccgctttccttcttactatcctgggtttcatcgatatttttgcaaggccggctgctggttttgtcgcagggctgggtaaggtccgcccttacagcgtgtacttattctcgttctctatgttctttaacggcctggccgatctggccggttcaaccgctggagactacgggggtcttgtggtattctgtatcttttttggcatcagctatggcatggttggagcgctgcagttcgaggttttaatggcaatcgtaggtacacacaaatttagctcggcaattggcctcgtcttgctgatggaggccgtcgcagtgctggttgggccaccaagcggcggcaaattgctagatgccactcatgtgtacatgtatgtgtttatccttgcgggtgcagaggttcttacctcctcgctgatcctactacttggtaatttcttctgtataagaaaaaagcctaaagagccccaaccggaagttgctgctgctgaggaagaaaagttgcacaagccccccgccgacagcggagtggacctcagagaggttgagcactttcttaaggctgaaccagagaagaacggagaggtagtgcacactcctgagacatcagtg

SEQ ID NO: 33732 - DNA, 1395 bp, Artificial Sequence
  Description of Artificial Sequence: Synthetic coding sequence
atgggaggagcagtcgtggatgagggcccgaccggtgtgaaggccccagatgggggatgggggtgggccgttctctttggctgtttcgtgatcaccggatttagctacgcgtttccaaaagctgtgtcggttttcttcaaagagctgatccaggagttcggcatcggttatagcgacacggcatggatctcgagcatcctgctggcaatgctctacggaactggacctttgtgtagcgtgtgcgtgaatcgcttcggttgccggccggtaatgctggttggcggactgttcgccagcctgggaatggttgctgccagcttttgccgctctatcatccaagtgtacttgactactggcgtgattacgggactgggtttggcgttgaactttcagccgtccctcatcatgctgaatcgatactttagcaagcgtaggcccatggctaatggactggcagcagccggctctcctgtgttcctttgtgcactgtccccactcgggcagcttctccaggaccggtacgggtggcgaggtggcttcctcatccttggtggactgctcctgaactgctgtgtgtgcgctgccctgatgcggccactcgtggtgaccgcgcaacctggttccggaccgccaagaccgagccgccgactcctcgatctctcggtgtttcgcgacagggggttcgtgctgtacgctgtcgcagcatcggtgatggtgctgggcctgtttgtgcccccggtgtttgtcgtgtcatacgcaaaggacctgggcgtgcctgacactaaagccgcgttcctcttgactatcctgggcttcatcgacatcttcgcccgcccggctgccgggttcgtggccgggctggggaaggtgaggccatacagcgtgtatttgtttagcttctcgatgttcttcaatggattggctgacctcgctggatcaactgcaggagattacggcggactggtcgtgttctgcatcttttttggaatttcttacggaatggtgggggcgctccagttcgaggttcttatggccatcgtcggcactcacaagttctcgtccgcaatcggcctggtcctgcttatggaagcggtcgccgtcctggtgggacccccatcaggcggtaagctgctcgacgcaacccacgtttacatgtacgtgttcatcctggctggggcggaagtgcttaccagctcgctgatcctgcttctgggaaacttcttctgcattagaaagaaaccaaaggaaccacagccggaagtggccgcggctgaggaagaaaagctgcacaagccgccggccgactcgggcgtcgatctgcgggaagtggaacatttcctgaaagcagagccagaaaagaacggagaagtggtccacactccagaaacttcagtg

SEQ ID NO: 33733 - DNA, 1395 bp, Artificial Sequence
  Description of Artificial Sequence: Synthetic coding sequence
atgggtggcgctgtcgtcgatgaaggcccaactggagtaaaggcaccagatggcggatggggatgggccgtcctgtttggctgctttgttattactgggttttcttacgcctttcctaaggccgtgagcgtgttcttcaaagaactgatccaagagttcggaataggctactcagacaccgcatggattagctctatcctcctggcgatgctgtacggaaccggccctctgtgcagcgtgtgcgttaaccggtttggctgcagacccgtgatgctagttgggggcctattcgccagcctgggaatggtggcggcctccttctgtaggagcatcatccaggtttatttaaccactggagtcattactggtttgggactggctctcaatttccagcccagcctaatcatgctgaaccgatatttcagtaaaaggagacccatggctaatggcctagccgccgcaggcagtccagtgttcctttgcgccctgagtcccctgggccagttgctgcaggacaggtacggctggagaggcggattcttgatcctaggcgggctccttctgaattgttgtgtttgcgctgccctgatgcggcccctggtggtgacagcccaaccaggctctggacctccaaggcccagcagaaggcttttagatctctcagtctttcgtgacagggggtttgttctgtacgccgtggccgccagcgtgatggtgctgggattgttcgtgccacccgtcttcgtggtcagctacgctaaggatttgggggtgcccgacactaaggctgccttcctgctaaccatcctgggcttcattgacatctttgcccggcccgctgctggcttcgtggccgggcttgggaaggttagaccttactccgtgtatttgttctcattttccatgttttttaatggtctggctgacctcgctgggtctactgccggggattatggagggcttgtggtgttctgcatcttttttgggatttcttatggcatggttggcgcactccaatttgaagttctcatggcgatcgttggcacgcacaaattttctagcgccattggactggtgcttctgatggaggccgttgccgtcctggttggccccccatccgggggtaagcttttggacgcaacccacgtgtatatgtatgtattcatcctcgcaggggcagaagtcttgacctcttcattaatactgctattggggaactttttttgcattaggaagaagccaaaggaaccccagcccgaagtcgccgcggccgaggaggagaagctgcacaagcccccagctgatagcggcgtggatctgcgggaggtggagcattttctcaaggcagagccagaaaagaatggtgaggttgtgcatacccctgagactagcgtc

SEQ ID NO: 33734 - DNA, 1395 bp, Artificial Sequence
  Description of Artificial Sequence: Synthetic coding sequence
atgggcggcgctgtagtcgatgagggaccaactggcgtcaaggcccctgatggcggttggggttgggcagtactttttggttgtttcgtgatcaccggcttctcttacgccttcccaaaagccgtctccgtatttttcaaagagctaattcaggaattcggcatcgggtattcagatacggcctggatcagtagcatattattggccatgctttatggaactggacctctttgttccgtgtgcgtcaatagatttggttgccgacctgttatgctagtgggaggactttttgcctcattagggatggttgcagcaagcttctgcagaagcatcatccaggtatacttgactaccggcgtcataaccggcctcgggttggcgctgaacttccagcccagcttgattatgctaaatcggtatttcagcaagcgtcggccgatggcaaatgggctggcagctgcaggatcaccagttttcctctgtgctctgagtcccctaggccagttgcttcaagacagatatggatggcgcggcggattcttaatcctgggtggcctcctcctgaattgttgcgtgtgcgcagccctgatgcgccccctcgtcgtgactgcccagcctgggtctggaccaccacgcccaagtagacggctgttagacttatcggtttttagggaccgaggttttgtgttgtatgcggtggccgcaagtgtcatggttcttgggctgtttgtacctcccgtcttcgttgtctcttatgccaaggacctcggtgtccccgacacaaaagccgcgttcctacttaccatcttaggcttcatcgacatttttgcccgcccagctgccggatttgtagccggcctcggaaaggtccgcccatacagcgtgtatttgttcagtttctccatgttctttaatggactggccgatctggccggcagtactgccggagattacgggggcttggtagtgttctgtatttttttcggcatttcgtacgggatggtaggagctctccagttcgaagtcctgatggcaatcgtaggaacccacaaattcagctctgccattggactagtcttattgatggaagctgtggcagtcctggtcggacctccctccggcgggaagttgctggacgctacacacgtgtatatgtatgtttttatccttgccggggctgaggttcttacatcaagtctgatcctactgctcgggaactttttttgtatccggaaaaaacctaaagaaccccaaccggaggtagctgcggctgaggaagaaaaactgcacaaaccacctgccgattcaggcgttgatctgcgcgaggttgagcactttctcaaggctgaacccgaaaagaacggcgaagtcgttcacactcccgaaacctctgtc

SEQ ID NO: 33735 - DNA, 1395 bp, Artificial Sequence
  Description of Artificial Sequence: Synthetic coding sequence
atgggcggagcggttgtggacgagggacctactggtgtcaaggcaccagatggcggctgggggtgggccgtgctgtttggttgctttgtcattaccggattcagctacgcatttccaaaggccgtttcagtgttctttaaggagctcatccaggaattcggtattggttacagcgatacggcatggatctcctccattctccttgcaatgctctacggaaccggacctctgtgttccgtgtgtgtcaatagatttggttgcagaccggtgatgttggttgggggtcttttcgctagccttgggatggtggcagccagcttctgccgctcgattattcaagtctacctgaccaccggggtgatcacggggctcggacttgccttgaatttccaaccttccctgattatgcttaacaggtacttcagcaaaagacgtccgatggcaaacggtcttgctgccgcgggatcgccggtctttctctgtgcactctcacccctgggacagcttctccaagaccgttatgggtggagaggaggttttttgattctggggggcctccttctgaactgctgcgtgtgtgccgcactgatgcgtcctcttgttgtcactgcacagcctggttcaggaccaccaagaccttcgcgcagactgcttgacctctccgtctttagggaccgcgggttcgtgctctacgccgtggcggcatccgtgatggttctgggactgtttgtgccccccgtgtttgtcgtctcgtacgcgaaggatcttggcgtccctgatactaaagctgcattcctgctgaccattctggggtttatcgacatatttgcgcgacctgccgcaggatttgttgcaggacttggaaaggtgcgcccttactccgtgtatcttttctcatttagcatgttctttaacggcctggcggatctggcaggatcgaccgcaggcgattacggaggcctggtggtgttttgtatcttctttgggatcagctacggaatggtcggtgcccttcaatttgaagtgcttatggccatcgttggcacgcataagttctcgtccgcaatagggctcgtgctgctgatggaggctgtggcagtgttggtggggcccccatcgggtggaaagctgctcgatgcaactcatgtgtacatgtacgtgttcatccttgcgggtgcagaggtgcttacctcttccctgattctgttgcttggtaacttcttttgcatccgtaagaaacccaaagagccgcagcccgaagtcgcagcggctgaagaggagaagctgcataagcctcctgccgactcaggagtggatctcagggaagtggaacactttcttaaagccgaaccagaaaagaatggagaagttgtccacaccccagaaacgagcgtg

SEQ ID NO: 33736 - DNA, 1395 bp, Artificial Sequence
  Description of Artificial Sequence: Synthetic coding sequence
atgggaggggcagttgtggacgaagggcctactggggttaaagctccagacggcgggtggggctgggcggtactgttcggttgtttcgttataactggtttctcttatgcctttcccaaggctgtaagcgtgtttttcaaggaactcatacaggagtttggaattggctatagcgatactgcctggatctcttcaattctccttgccatgctctacggcacagggccactgtgcagcgtatgcgtaaatcggtttggctgccggcccgtcatgctggtgggcggcctattcgcatccttgggcatggttgccgcctctttttgcagatctatcatccaagtctacctgacaacaggagtaattaccggccttgggctggcactcaactttcagccttctctgattatgcttaacagatatttttctaagcggaggccaatggccaacgggctagctgcagcaggatcacctgtgtttctgtgtgcactgtctccactagggcagctgctccaggatagatatgggtggcgcggcggatttctgatcctgggaggccttttgctgaattgctgcgtgtgcgccgcccttatgcggcctttggtagttacagcccagcccggctctgggcctccccgcccgtcaaggcgcctgctggatctgtcagtcttccgggacagggggttcgtgttatatgccgttgccgcctctgtcatggttttaggcctgtttgtgcctcccgttttcgtggtttcctacgcaaaagaccttggggtaccggacactaaggcagcgtttcttctcaccattctgggcttcatcgacatattcgcgagacctgccgcgggatttgtggcaggcttgggcaaggtgcggccatattcagtttacctgttcagcttctccatgttcttcaacggcctggccgacctggctggcagcacagccggcgattatggcggcctcgtggtcttctgtatcttcttcggcatttcgtacgggatggtaggcgcgctccagtttgaagttctgatggcaattgttggaacccacaagttttcatccgcgatcggattagtgctcctcatggaggccgtagccgtgctcgtgggccccccttctggaggtaagctcctcgatgccacacatgtttacatgtatgtcttcatcctagcgggagccgaggtgttaaccagctctctcattctgctgttgggaaacttcttctgcattaggaaaaagccaaaagagcctcagccagaagtcgctgccgctgaggaggagaaacttcacaaaccacctgctgatagcggggttgacctcagagaggtggaacattttctgaaggccgaaccagaaaagaacggcgaagtggtgcatactccagagacctcggtg

SEQ ID NO: 33737 - DNA, 1395 bp, Artificial Sequence
  Description of Artificial Sequence: Synthetic coding sequence
atggggggcgccgttgtggatgaaggccctacaggggtgaaggcacccgatggcggctgggggtgggccgtgctctttggatgtttcgttattacaggatttagctatgccttcccaaaagccgtgtcagtgtttttcaaggagctaatacaagagttcgggatcggctactccgatactgcatggatctcttcaatcctactggccatgctttatggaaccggccctctgtgcagtgtttgcgtcaatcgctttggctgcaggcccgtcatgcttgtaggcgggctgttcgcgtccttgggcatggttgcagcttccttttgccgctctatcatccaggtctacctcacaacaggcgtgattaccggcctgggcctggcactgaacttccaacctagcttgatcatgctgaatagatatttctcaaaacggcgtcccatggcaaacggtttagcagcagccgggagtccagtgtttctgtgcgctttgtctcccctgggccaactgctccaggaccggtacgggtggcgggggggttttctaattctcgggggtctcctcctgaactgctgcgtgtgtgcggcccttatgagacctttggtcgtgacagcccagcctggcagcggtccaccccgaccttcacgtaggctcctggacctgtccgttttcagagatcgagggtttgtgttatacgctgtggccgcttcagtcatggtgctgggcctctttgtgccgcccgttttcgtggtgagctacgccaaagatctcggagtaccagacactaaggcagcgtttttgctgaccattctgggatttatcgacatttttgcacgacctgcagccggtttcgtggcaggactaggcaaagtgagaccatacagtgtgtacctcttttccttcagtatgttcttcaatggacttgccgacctggccggatccaccgccggtgactatgggggcttagtggttttctgcatattttttggaatttcatatggcatggtaggggccctgcagttcgaagtactcatggccatcgtcggcacgcacaagttctcatccgcaataggcttggtgctgctgatggaggccgtcgctgtgctggtagggccgccctctggcggcaagctgctcgatgcgacacatgtgtacatgtatgtgtttatcctcgctggtgccgaggtgttgacctcttctctgatcctcctgcttggcaatttcttttgcatccgaaaaaagcccaaggagccgcagccggaagtcgccgccgcagaggaggaaaaactgcacaaacctccagcagactccggtgtagacctcagggaggttgaacatttccttaaggctgagcccgagaaaaatggagaggtcgttcatacacccgagacaagcgtc

SEQ ID NO: 33738 - DNA, 1395 bp, Artificial Sequence
  Description of Artificial Sequence: Synthetic coding sequence
atggggggtgctgtggtagatgaaggccctacgggggtgaaagcgcctgatggcggatggggctgggccgtccttttcggttgcttcgtcataactgggttttcctatgcattcccgaaagctgtgtccgtcttcttcaaagaactcatccaagagttcggtatcggctatagcgatactgcctggattagctccatactgctagcaatgctctacggaaccggcccactgtgttcagtgtgtgttaaccgcttcggctgccgcccagtcatgctggtcggcggccttttcgcctctctgggcatggtggccgcctccttttgcagatcaattatacaggtgtatttgaccaccggagttattaccggtctcggactagcactgaacttccagccaagcctgataatgctgaacagatacttttccaagcgtcgtccaatggctaacggcctcgctgcagccggatccccggtgtttctctgcgccctgtcccctttaggccagctactacaggaccggtatggctggcgagggggcttcctgatcctgggaggcttgctgttaaattgttgcgtgtgtgccgcccttatgcgacccctggtggtgaccgcccagcccggatccggccctccccgcccgtcaaggaggcttctggacctgagtgtgttccgtgaccggggttttgtgctctacgctgttgctgcgagtgttatggtcctaggactcttcgtaccgcccgtgttcgtggtctcctacgccaaggatctcggcgtgccagacaccaaagccgcctttctgctcactattttaggatttattgatatttttgccaggccggcagcaggatttgtagcagggctggggaaggtgcgtccgtacagcgtttatctatttagcttctccatgtttttcaacggactggcagatctggcaggctccacggcaggcgactatggcgggttagtggtgttctgcatcttcttcggcattagctatggcatggtgggtgctctccagttcgaggtgcttatggccatcgtgggaacccataaattctcctccgctatcggtctggtcctcctcatggaagccgtcgctgtcttggtggggccaccgagtgggggtaagctgttggacgctacgcatgtgtatatgtacgtgtttatcctggccggtgccgaagtgctgaccagttcccttatcctcctgctcgggaatttcttttgcattaggaagaagcccaaggagccacagcctgaggttgccgctgccgaggaggagaagctccacaagcctccagccgattccggcgtcgatttgcgggaagtggagcacttcctgaaagccgagccagaaaagaatggcgaggtcgtgcatacccctgaaacctctgtc

SEQ ID NO: 33739 - DNA, 1395 bp, Artificial Sequence
  Description of Artificial Sequence: Synthetic coding sequence
atggggggagcagtcgtggatgagggcccaactggagtgaaagcacctgacggaggctggggatgggctgtcctctttggttgcttcgttatcacgggtttttcttatgcattccctaaggccgtgtccgtgttctttaaagaattgattcaagagttcggcattggttactcggataccgcctggatttcctcaattttgcttgcgatgctttatggcactgggccgctatgctccgtctgtgttaatcgctttgggtgtcggccggttatgcttgtaggggggctcttcgcttctctgggcatggtggctgcatcattttgtcgctcaataatccaggtataccttacaacgggcgtgattaccggccttggtttggccttaaatttccaaccttcgcttatcatgcttaatcgatacttctcgaaacggcgccctatggcaaatggtctggcagcagccggctctcctgtcttcttgtgtgcgttgtcgccgctgggacaactcctacaagaccggtatggttggcgcgggggatttttaattttgggtggtctgctgctgaattgttgtgtttgtgcggcgctcatgcggccgctagtggttactgcccaacccggatcaggacccccccgcccatctagacgccttttggacctgagtgtcttccgagatcgggggttcgttctttatgctgtggcagctagcgtgatggtgctgggattgttcgtgcctcctgtttttgtggtttcctatgctaaggatttgggggtccccgacacgaaggcagctttccttctaaccattctcggattcatcgacatcttcgcccggccagctgctggctttgtggctggccttggaaaggtccgaccttacagcgtttacctcttctcgttctcgatgttcttcaacggcttagccgatctggcaggatcaactgcaggagattatgggggtctcgttgtattctgtatcttcttcgggatatcgtacgggatggtaggcgcacttcagttcgaagtgctgatggctatcgtagggactcacaaattctcaagtgctattggcctcgttcttcttatggaggcagttgcagtacttgtgggccctccttccggaggtaaactgctagacgctacacatgtctatatgtatgtctttattttagctggagctgaggttctgacaagttccctcatcttgttgttaggaaacttcttttgcattcggaaaaagcctaaggagcctcaaccggaagtcgcagcagctgaagaggagaaacttcataaaccaccagcggatagcggagtagacctgcgtgaagtagagcacttcttgaaggctgaaccagaaaagaacggagaagttgttcatacgcctgagacctccgtg

SEQ ID NO: 33740 - DNA, 1395 bp, Artificial Sequence
  Description of Artificial Sequence: Synthetic coding sequence
atgggcggagcggtcgtcgacgaaggcccgacaggcgttaaagcgccggacggcggctggggttgggctgtactcttcggttgcttcgttattacaggtttctcttatgcatttccaaaagcagtctccgtattttttaaggaactgatccaagaattcgggatcggttactctgacacggcttggatttcgagcatactccttgccatgctgtatggaacgggtcctctgtgctcagtctgtgttaatcgctttgggtgccgcccggttatgcttgtaggtggattgtttgcatcattagggatggtcgccgcgagcttctgccgatcaattattcaggtttacctgacaacaggggtgatcacaggtttaggcttggccttaaatttccaaccgtctttgattatgcttaatcgatattttagcaaacgtcgtccgatggctaatggactggcagcggcgggatcgcctgtctttctgtgtgcgttgagcccgctgggacaacttttgcaagatcggtatgggtggcgcgggggctttttaattctgggtggattgttgcttaattgctgtgtctgcgctgcccttatgcggcctttggttgtaacggcgcagcccggttccgggccgccaagaccaagcaggcgtttacttgatctgtctgtatttagagacagaggattcgttctgtacgcggtcgctgccagcgttatggtcctgggactcttcgtgcctcctgtttttgttgtttcttacgcaaaggacttgggcgtgccggatacaaaagcagctttcctgcttacaatcttagggtttatagatatttttgcacgtcctgctgcagggtttgttgcaggtctgggaaaagtcagaccgtattcagtgtatttattcagcttttcaatgttctttaatggccttgcggatctagctggttccacagcgggcgactatggaggactcgttgtcttttgcattttttttggtatctcatatggcatggtgggcgcccttcaatttgaggtgttgatggcaattgtcggaacgcataaattctcatctgccattggcctggtgctgcttatggaagcggtcgcggtcttggttggaccgccatcaggtggaaaattattagacgcaacccatgtgtatatgtacgtgtttattttagcgggcgcagaagttcttacatcaagccttattttgctcctgggcaatttcttctgcattcgcaagaaaccgaaggaaccccaaccggaggtggcagcggctgaggaagagaaactccataaaccaccggcggattcaggagtggatttgagggaagttgaacacttccttaaggctgaaccagaaaagaacggggaggtcgtgcacacgccagagacgtcagtt

SEQ ID NO: 33741 - DNA, 1395 bp, Artificial Sequence
  Description of Artificial Sequence: Synthetic coding sequence
atgggcggggcagtcgttgatgaaggtcctacgggggtgaaggcaccagatggaggatggggatgggcagtgctttttggttgtttcgtgatcactggcttttcctacgcattccctaaggccgtttccgtgtttttcaaggaacttattcaagaatttgggattggctactcggacactgcttggatcagctcgatacttcttgccatgctgtacggaactggcccactctgttctgtgtgtgtcaatcgctttgggtgcaggccggtgatgctcgtgggcggactctttgcgagccttggcatggtggcagcatcgttctgccggtcgattattcaggtctatctgacgactggggtgattaccggactcggattggccctgaacttccagccatcacttatcatgctgaatcggtacttttccaaaagacgaccgatggctaacgggcttgccgcagcaggcagcccagtctttctctgcgcactgtcacccctcggtcagctcctccaagatcgctacggttggcggggtggctttcttatccttggtggccttcttctcaattgctgtgtgtgtgcggcgctgatgcggccccttgtggttaccgcacaacccggatcgggacctcccagacctagcaggagactgttggacctttcggtgtttcgcgaccggggtttcgtcctgtacgcagtggccgcctcggtcatggtcttgggactctttgtgccacctgtgtttgtggtgagctatgcaaaagaccttggtgtccctgatactaaggcggcatttctgcttactattctgggctttatcgacatcttcgccagacctgccgcagggtttgtggcagggctcggtaaggtccgaccttactcggtgtaccttttctcattctcgatgttctttaacggacttgcagacttggcaggcagcaccgcgggagattacgggggactcgtggtgttctgtatcttttttggaatttcatacggtatggtgggggcacttcaattcgaggtgcttatggccatcgtgggaacccacaagttttcatctgcgattggtttggttcttctgatggaagccgtcgcagtccttgtgggcccaccgtcgggaggtaaacttctcgacgcaactcatgtgtacatgtacgtctttatcctcgctggtgcagaggtgctgacctcctcgctcattctccttctgggtaactttttctgtatacggaagaagccaaaggagcctcaacccgaggttgccgcggcagaggaagagaagctgcataaaccgcctgctgattccggtgtcgatctgcgagaggtggaacacttccttaaggcagaacccgaaaagaatggggaggtggtgcatactccagaaacttcggtg

SEQ ID NO: 33742 - DNA, 1395 bp, Artificial Sequence
  Description of Artificial Sequence: Synthetic coding sequence
atgggaggcgccgtggttgacgaaggccctaccggggtcaaggccccggatggcggatggggatgggcagtgctgtttggttgtttcgtcatcactggtttctcatacgcattccccaaggccgtctcggtctttttcaaagaactgatccaggagtttggcatcggatactccgacaccgcctggatctcctcgatactgctggcaatgctctacggtaccggccctctctgttcggtgtgcgttaatcgctttggatgcagaccagtgatgcttgtcggaggcctgttcgcctccctgggcatggtggccgcctcattctgcagatctataatccaggtctacctgactaccggggtgatcactggattgggtctggccttgaacttccagccgtcgctcatcatgctgaaccggtacttctctaagagaaggccaatggcaaacggcctggcagccgcgggcagcccagtgtttctctgcgccctgtccccactggggcaactcctgcaagatagatacggatggcgcggcggattcctgatcctcggaggcctgctgctgaattgctgtgtgtgcgccgcgctgatgcgcccgctggtggtcactgcccaaccggggtcggggccgccgaggccgtcccggaggctgcttgacctcagcgtgttccgcgaccgcggtttcgttctctatgctgtcgcggcctccgtcatggtgctgggactcttcgtgccaccggtattcgtggtcagctacgcaaaggacttgggcgtcccggatactaaggcagcattcctgctgaccatcctgggattcattgacatcttcgcccggcccgcggccggcttcgtggcgggacttgggaaggtaagaccatactcggtgtacctgttcagcttctcaatgttctttaacggactggctgacctcgcggggagcaccgccggagactacggaggtctggtcgtgttctgtatctttttcggaatttcctacggtatggtgggtgccctgcaatttgaagttctgatggccatcgtggggactcacaaattctcctcggcgatcggactggtcctgcttatggaagcagtggctgttctcgtgggccctccgtcgggaggtaagttgctcgatgccacccacgtctacatgtacgtctttatcctggccggagccgaggtcctgacttcgtcattgattctgctccttggaaatttcttctgcatcaggaagaaaccgaaggaaccgcagccggaagtggccgcggcagaagaggagaaactgcacaagcccccggccgactccggcgtggacctgcgcgaggtcgagcatttccttaaggctgagccggaaaagaatggagaagtggtgcacaccccggaaacttcagtc

SEQ ID NO: 33743 - DNA, 1395 bp, Artificial Sequence
  Description of Artificial Sequence: Synthetic coding sequence
atggggggcgcagtggtggacgaaggacctactggagtgaaggcaccagatggcgggtggggttgggccgtcctgtttgggtgttttgtcataaccggcttctcatacgcgtttccaaaggcggtcagcgtattctttaaggaacttattcaagagtttggtattgggtattcggacaccgcttggatttcctcgatccttctcgctatgctgtacgggaccggacccctgtgttcggtgtgtgtgaatagatttggatgtcggccggtgatgctggtcggggggttgtttgcgtccctgggaatggtggcagcatcattttgtcgttcgattattcaggtctacctgactacgggagtcatcactgggctgggtctggcactgaactttcaaccatccctcattatgttgaatagatactttagcaaacggcgacctatggctaacggtctggccgcagccggatcgcctgtgttcctgtgcgccctctcacctctggggcagctgttgcaagatcgctacgggtggcgcggggggtttcttatactcggaggtttgctgctgaattgctgtgtgtgtgccgcgcttatgcgcccccttgtggtcaccgcacaaccaggatccggaccaccccggccttcgagacgcctgctggatctttcagtatttagggatagaggttttgtgctctacgcagttgcagcaagcgtcatggtgctgggtctgttcgttcctcctgtgtttgtggtgagctacgcaaaagatttgggtgtccctgatacgaaagcagcattcctgctgaccatcctcggatttatcgacatcttcgcgcgtccagcagcgggatttgtggcaggtctgggtaaagtaagaccctactcggtgtacctctttagtttctcgatgttcttcaacggacttgcggatcttgcaggatccaccgcaggtgattacggcggtcttgtggtcttttgcatattcttcggtatcagctacggcatggtgggagcattgcagtttgaagtgctcatggcaatcgtgggaacccacaagttcagttcagccataggattggtacttctgatggaggcagtggccgtccttgtgggacctccttccggtgggaagctccttgacgccactcatgtgtatatgtacgtgtttatactcgcgggagctgaagtccttactagctcacttatcctcttgctcggtaacttcttttgcattaggaagaaaccaaaggaaccgcagccagaggtggccgccgcagaagaagaaaagctgcataagccgccagcagattccggagtggaccttagagaagtcgaacactttctgaaggccgagcccgagaagaacggcgaggtggtgcatacccctgaaacttcggtc

SEQ ID NO: 33744 - DNA, 1395 bp, Artificial Sequence
  Description of Artificial Sequence: Synthetic coding sequence
atgggaggcgccgtggtggatgaaggtcccactggggtgaaggctccagacggcggctggggctgggccgtgctgtttgggtgctttgtgataaccgggttttcctacgccttccccaaggccgtgtccgtgtttttcaaggaacttatccaggagtttggaatcgggtatagcgacactgcgtggatctcttcaattctccttgccatgctgtatggcacaggtcccctctgctccgtttgtgttaatagatttggctgtaggcccgttatgttagtgggcgggcttttcgcttcgctgggcatggtcgctgcaagtttctgtaggtctatcattcaggtgtacctaactacaggggtgattactggcttaggactcgcgctcaatttccagccatccttgattatgctaaacaggtatttttctaagcgacgaccaatggccaacggactggcagccgctggctccccagtgttcctctgcgccttgtcaccattgggtcaactcctgcaggacagatatgggtggcggggcgggttcctgatcctgggtggactcctgctgaactgttgcgtatgcgctgctttaatgaggcctttggtcgtaacagctcagcctggttcggggcccccaagacctagccgccgcctcctggacctgtccgtctttcgtgatcgggggtttgtcctctatgccgttgcagccagcgtaatggtgctgggattatttgtgccacccgtgttcgtggtgagctatgccaaggacctaggcgtgccagatactaaagcggcttttctgctcactatactaggctttatcgacatttttgcaagacccgcggctggctttgtcgccggcctgggaaaggttcgcccatacagtgtgtatctgttttctttcagcatgttcttcaacggactcgctgaccttgccggttcaaccgccggcgattacgggggtctcgtggttttttgcatcttttttggcatctcgtacggtatggttggggccctgcagttcgaagtcctcatggccatcgtgggaacacataagttcagttccgccattggcctggtgctcctgatggaagctgtcgcagttcttgtggggccaccctcaggagggaaactactcgatgccacccacgtttacatgtatgtttttattctggccggggcagaggtgctgacgagctctcttatcctgctattgggaaacttcttctgcatcagaaagaagcccaaggaacctcagcccgaagtggctgcggcagaggaagagaagctgcataaaccaccagcagacagtggcgttgatctgagagaagtggagcactttctcaaggcagaacccgaaaagaacggtgaggtggtgcacacaccagagacatccgtc

SEQ ID NO: 33745 - DNA, 1395 bp, Artificial Sequence
  Description of Artificial Sequence: Synthetic coding sequence
atggggggggccgtggttgacgaaggccctacaggagtcaaggcccctgatggcggatggggctgggcggtcctgtttggatgttttgtgatcacaggattctcctacgcctttcccaaggccgtgagtgtcttctttaaagagctgattcaggagttcggaattggttacagtgacactgcatggatatcctccattttgctcgccatgctctacggaacagggccgttgtgctccgtctgcgtgaataggttcgggtgtaggcccgtgatgttggtgggaggacttttcgcttcactgggaatggtggccgcctccttctgcaggagcatcatccaggtctatctgacaacaggagtgattaccggactgggtctggccctgaacttccagccatctcttatcatgcttaaccgctattttagcaagaggaggcctatggccaatggactggctgcggctggctccccggtttttctgtgcgccctttcgccactgggccagcttcttcaggaccggtatgggtggcgcgggggatttctgatcctcgggggtctgctgctcaactgttgtgtttgtgccgcactaatgcgtcctttagtcgtaacggcccagcccggcagcggacctcctcgcccctctaggagacttctggatctatcagtcttcagggatagaggcttcgtgctgtatgctgttgccgcctctgtgatggtacttggtctattcgttccccctgttttcgtcgtgagctacgccaaagatttaggagttcctgacactaaagctgcttttctgctgactattctaggatttatcgatatcttcgcccgaccagccgctggcttcgtggccgggctgggcaaagtaaggccatattctgtctatctattttctttctctatgttctttaacggcttagccgatctggccgggtcaacagcaggagactacggcggactcgtggtgttctgtattttttttgggatctcctacggcatggtaggagcgctgcagtttgaggtgcttatggctattgtggggacccacaagttcagtagcgccattggcctcgtgcttctgatggaagctgtcgcggtactagtgggtcctcctagcggtggcaaactcttggacgccacacacgtttacatgtatgtgttcattcttgctggggccgaagtgttgacttctagtctgatcttactacttggaaattttttttgtataaggaaaaagcctaaagaaccccagcccgaggtagcagccgctgaggaggagaagcttcacaagcctcccgccgatagcggcgtagacctccgggaggtagaacattttcttaaggcagaaccagaaaagaacggcgaggtggttcataccccggagacctcagta

SEQ ID NO: 33746 - DNA, 1395 bp, Artificial Sequence
  Description of Artificial Sequence: Synthetic coding sequence
atgggaggagcagttgtagatgaaggaccaactggtgtaaaagcaccagacggaggatggggatgggcagttttatttggttgttttgtaattacgggattcagttatgcatttccaaaagctgtgagtgtttttttcaaagaacttattcaagaatttggaattggatattcagatactgcatggatttcaagtattttacttgctatgctttatggaactggtccattatgttcagtgtgtgttaatagattcggatgtagaccagtaatgcttgttggtggtctttttgcatcacttggtatggtagctgcttctttttgtagatctattattcaagtttatttaacaactggtgttattacgggtttaggtcttgctcttaattttcaaccaagtttaattatgttaaatagatactttagtaaaagacgtccaatggctaatggactcgcagcagctggatctcctgtattcctttgtgcactttctccattaggacaattacttcaagatagatatggatggcgtggtggatttttaattcttggtgggttattattaaactgttgtgtgtgtgcagctcttatgagaccattagtagttactgctcaacctgggtcaggaccaccaagaccatcacgtcgtcttctagatttaagtgtttttagagatagaggttttgttttatatgctgttgctgcttctgtaatggttctcggattatttgttccaccagtttttgttgtttcatatgcaaaagaccttggagtgccagatacaaaagctgcatttcttcttacaatacttggattcattgatatttttgcaagaccagcagcaggatttgttgcaggacttggtaaagttagaccatattctgtatatcttttttcattctcaatgttctttaacggtttagcagatttagcaggatctacagccggagattatggaggacttgttgttttttgtattttctttggaatttcatatggaatggtgggagcattgcaatttgaagttttaatggcaattgttggtacacataaattttcatcagcaattggacttgttttattaatggaagcagttgctgttcttgttggaccaccaagtggtggaaaattactagatgctacacatgtttatatgtatgtttttattcttgcaggagctgaagtattaacttcttctttaattttattattaggaaattttttctgtatcaggaagaaaccaaaagaacctcaaccagaagtagcagcagctgaagaagaaaagttgcataagccaccagctgatagtggagttgatttgagagaagtagaacattttctaaaggcagaacctgaaaaaaatggtgaagttgttcatacacctgaaacttctgtc

SEQ ID NO: 33747 - DNA, 1395 bp, Artificial Sequence
  Description of Artificial Sequence: Synthetic coding sequence
atgggtggagccgtggtcgacgagggacctacaggtgtgaaggcgcctgatggcggatggggctgggcggtcctctttggatgtttcgtcatcaccggcttttcttacgctttcccaaaagccgtatccgtgttttttaaggagcttatacaggagtttgggatcggatacagcgacaccgcttggatttcctcaatcctgctcgccatgctgtatgggaccggccccctgtgctcagtttgcgtgaacaggttcggctgtcggcctgtgatgcttgtaggcggcctgttcgcctcattggggatggtggccgctagcttttgtagatccattattcaagtctacctgaccacaggagtgatcacgggattaggtcttgccctgaatttccagcctagcctgattatgcttaataggtatttctcaaaacgccggccaatggctaacggtctcgctgccgcgggctcacccgtcttcctgtgtgctctaagcccccttggacagcttttgcaggaccgctacggctggagagggggatttctaatacttggcggtttgctgctcaattgctgtgtgtgcgctgcccttatgcggccattggtggttacagcccagcccgggagcgggccgcctcggccctcacggcgtttgttagatctctctgtgttcagagaccgtggcttcgtgttgtacgccgtggctgcaagtgtaatggtcttgggactgttcgtgccccccgttttcgtcgtatcttatgctaaagatctcggagttcccgacaccaaggcggctttcctcctcaccattcttgggttcatcgatatttttgcacgccctgctgctggcttcgtggctggtctcggtaaagttcgaccctacagtgtctatttattctccttttcaatgttttttaacggcttggcagatctggcaggtagtactgcgggtgactatggagggctggtggtgttttgcatctttttcggcataagctatgggatggtcggagcattgcagttcgaggtgctcatggctatagtggggacacacaagttttcatcagcaatcggcctcgtgttactgatggaggcagtcgctgtgctcgtggggccaccctccggaggcaaactactggacgccacccacgtctatatgtacgtttttatcctcgccggagcggaagttcttacatcctctctgatcctcctcctgggcaatttcttctgcatccggaaaaagcccaaggaacctcagccagaagtcgctgcagctgaagaggaaaaactgcacaagcctccagcagacagtggcgtggatttacgagaagtggagcacttcctgaaggcggagcccgaaaagaatggtgaggttgtgcacacccctgagactagtgta

SEQ ID NO: 33748 - DNA, 1395 bp, Artificial Sequence
  Description of Artificial Sequence: Synthetic coding sequence
atggggggtgcagtcgttgatgagggacctaccggggtaaaggctcccgacggcggatgggggtgggctgtgctttttgggtgttttgtgatcacgggtttttcctatgcgttcccgaaggccgtaagcgtctttttcaaggaactcatccaagaatttggaatcggatactccgacacggcctggatcagttccattctgcttgctatgctctatggcaccggccccctctgcagtgtgtgcgtaaacagattcgggtgtaggcccgtcatgctggtcgggggccttttcgccagcctggggatggtggcagcctctttttgtcgatcaattattcaggtctatctaacaacaggcgtcataactggtctggggctggcattaaattttcagcctagcctgattatgctgaatcggtatttttcaaaaagaagacccatggctaacggattggccgctgctggtagcccggtgttcttgtgcgcactcagccccctgggacagctcctgcaggatcgttacggttggcgcggcggctttctgattcttggaggcctccttttgaactgctgcgtgtgtgctgccttgatgagacccctagtggtgactgctcagccggggtccggtccccccaggccctccagacgtctgttggatttgtccgtctttcgcgatcgggggtttgtgctgtatgccgtggcggcttctgttatggtcctaggtttgttcgtgccccctgtgttcgtcgtcagttacgccaaggatctgggtgtccccgatacgaaggcagcgttcctactcaccatcctgggcttcatcgacatctttgccagacccgcagctggcttcgtcgccggcctgggcaaggtccggccctactcagtgtaccttttttcattttcaatgttcttcaacggcctcgctgatctcgccggcagcactgctggagattatggcggcctggtagtgttctgcatcttcttcggcatttcatacggcatggtgggggcactacagttcgaggtccttatggccattgtcgggactcacaagttctcttccgccatcggcctggtcctgctcatggaagcagttgctgtactggtgggcccgccctccggagggaagctgctcgacgcaacccacgtctacatgtacgtgttcatcctcgccggggctgaagtcctgacatcctccttgattctcctacttggcaactttttttgcatcaggaaaaagcccaaggagcctcagccagaggtcgccgccgccgaggaggaaaagctgcataaacctcctgctgactctggagtagatctgagagaggtggaacactttctgaaagctgagcccgaaaagaatggagaggtggttcacacccccgagacctccgtg

SEQ ID NO: 33749 - DNA, 1395 bp, Artificial Sequence
  Description of Artificial Sequence: Synthetic coding sequence
atgggtggcgctgtggtggacgaaggcccaaccggggtgaaggcacctgatggagggtggggctgggcagtgttgttcggatgcttcgtgatcacgggtttcagttacgctttcccaaaggctgtgagcgtgttcttcaaggagcttatccaagagtttggaatcggatattccgataccgcgtggatctcttcaattttgctggctatgttatatggtaccggtccgctttgttccgtctgtgtgaatcggttcggctgtcgcccagtcatgctggttggcggcctcttcgccagtctcggaatggttgctgcctctttctgcagatcaattatccaggtgtatctgaccacaggggtgattactgggcttggcctggctctgaacttccaaccatctttaatcatgttgaacaggtacttctcgaagaggcgaccgatggccaatggccttgctgctgccggctctcctgtttttctttgcgctctttctcctctgggacagctcctgcaggacaggtatgggtggaggggagggtttctcatcctggggggcttactgcttaactgttgtgtgtgcgcagccctgatgaggccactagtggtgactgcacagcctggatccgggcctcccaggcccagcaggaggttgcttgacctgagcgtgtttagagaccgcggatttgtgctgtatgctgtcgcggcatcagtgatggtgttgggcctgtttgtccctccagtgttcgtcgtgtcctacgccaaagatctcggagtgcctgataccaaagcagcattcctgttaacaatccttgggttcatcgacatcttcgcccgcccggccgcaggcttcgttgcaggactggggaaggtgcgaccctatagcgtgtacctctttagcttttccatgttctttaacggactggcagacctcgctggttctactgcaggagattatggcggattggtcgtgttctgtatcttctttggaattagctacggaatggtgggagcgctgcaatttgaagtgctgatggcaatcgtgggtactcataaattctccagcgcaatcggcctggttttgctcatggaagcagtggccgtcctggtcggcccaccttccgggggaaagctcctcgatgctacacacgtatacatgtacgtcttcattttggccggcgctgaagtgctgacctctagtctaatcctgctcctgggcaacttcttttgcatccgcaaaaaacccaaagagccgcagcccgaggtggctgctgctgaggaagaaaaactgcacaaacctcctgcagattcaggtgtggatctgcgggaggttgagcatttcctgaaggccgagcccgagaaaaatggggaagttgtgcacacacctgagactagcgtc

SEQ ID NO: 33750 - DNA, 1395 bp, Artificial Sequence
  Description of Artificial Sequence: Synthetic coding sequence
atgggcggagccgttgtggacgaaggaccaacgggagtgaaggctccggacggaggatgggggtgggctgtgctcttcggatgctttgtaattaccggatttagctacgcgttcccgaaggctgtctctgtgtttttcaaggaactcatccaggagtttggtatcggatactccgacactgcctggatctccagcattctgcttgccatgctgtacgggacgggacccctgtgcagtgtatgtgttaatagattcgggtgtagaccggtgatgttggtagggggattgttcgcctccctcggaatggtggccgcttcattctgcagaagcataatccaggtttacctcaccaccggagtgattaccggactgggactggccctcaactttcagccctcgctcatcatgctgaaccggtacttctccaaacgacgcccgatggctaacggcctcgctgcagccggctcgcccgttttcctctgtgccctcagccctctgggacaactgctgcaggatcggtacggatggcggggcgggttcctgatcctgggaggactgttgctgaattgctgtgtgtgcgccgcactcatgcgccctctggtggtgactgctcaacccggatcaggcccgccacgcccgtcaagacggctcctcgatctgtcggtgtttcgggatcgtggtttcgtcctctacgctgtcgcggcatcggtgatggtcctcgggctgttcgtgccgccggtgtttgtcgtgtcctacgcaaaggacctcggggtcccagacactaaggccgcgttcctcttgaccattctggggtttatcgatatcttcgcacgcccagcggcgggttttgtggcaggactcggaaaggtgaggccctatagcgtgtatttgttctcattctccatgttcttcaatggcttggcggacctggctggatccactgcgggggattacggcgggctggtggtgttttgcatcttctttggaatctcctacggcatggtgggagcccttcagttcgaggtgcttatggctatcgtcgggacccacaaattctcctctgccatcggtttggtgctgctgatggaggcggtcgcagtcttggtcggcccgccatcgggaggtaaactgcttgacgcgactcacgtgtacatgtacgtgttcatcctcgccggagccgaagttctgacctcctcattgatcttgcttctgggaaacttcttctgcatccggaagaaacctaaagaaccccaaccggaggtcgcggcggctgaagaggagaaactccataagccgccggcggatagcggagtggacctgagagaggtcgagcacttcctgaaggccgaaccagaaaagaacggagaagtggtgcacactccagaaaccagcgtg

SEQ ID NO: 33751 - DNA, 1395 bp, Artificial Sequence
  Description of Artificial Sequence: Synthetic coding sequence
atgggcggagcggtggtggacgagggaccgacgggagttaaggcccctgacggcggatggggatgggccgtgcttttcggatgcttcgtgatcaccggcttttcgtacgcattccctaaggcagtgtccgtctttttcaaagagctgatccaggaatttggaatcggatactcagatactgcctggatttccagcatcctccttgcgatgctgtacggcaccgggccgctctgctccgtgtgtgtgaaccggtttggatgccgcccagtcatgcttgtaggaggactcttcgcatccctcggaatggtggccgcgtcattctgtcgctcaatcatccaggtgtacctgaccactggcgtcatcaccggactcggcctggccctcaattttcagccgagccttatcatgctcaaccggtatttctcgaagagacggcctatggcaaatggcttggctgccgccggttcgccggtgttcctgtgcgctcttagtccactgggacagctgctccaagaccgctacggctggcggggaggattcctgatcctgggaggacttctgctgaactgctgcgtgtgcgccgcgctcatgcgcccgctcgtggtgactgcgcaaccgggatcggggccacctcgaccgtcgagaaggctgctcgacctctcagttttccgtgatcgtgggttcgtgctgtacgctgtggccgcttccgtgatggtgcttggcctgttcgtgccgccggtgttcgtggtgagctacgccaaggatctgggtgtccccgacactaaggcggcgttcctgctgaccatactcggctttattgatatcttcgctaggcctgctgccggttttgtggctggcctcggaaaggtgcgcccgtacagcgtctacctgttctccttttcgatgtttttcaacgggctggccgacctggctggatcgaccgccggtgactacggcgggctcgtggtgttttgtatctttttcggaatctcatacgggatggtgggagcccttcaatttgaagtgcttatggcgatcgtgggaactcacaaattcagctccgccatcggactcgtgctgctgatggaggccgtggccgtgctggttggaccaccatcgggaggcaaactcctggacgcaactcacgtgtacatgtacgtgttcatcttggccggagccgaagtcctgacctcgtcactgattctcctcctgggaaatttcttctgtatccggaaaaaacctaaggagccccagcctgaagtggcggccgctgaagaagagaagctccataagccaccagcagactcaggagtagatctgcgggaagtggagcacttcctgaaggccgagccggagaaaaatggggaagtggtgcatacgcctgaaacctccgtt

SEQ ID NO: 33752 - DNA, 1395 bp, Artificial Sequence
  Description of Artificial Sequence: Synthetic coding sequence
atgggaggtgcagtggtcgatgagggaccaactggagtcaaagccccagacggcggctggggttgggcggtgttgtttggctgttttgtgatcaccggtttctcatacgcattcccgaaggcagtcagtgtgtttttcaaagagctcattcaggagttcgggatcggttacagcgatacggcgtggatctcctcgattctcctcgccatgttgtacggaacgggaccgctgtgttcggtctgtgtgaatcgctttggctgtaggccagtgatgctggtgggaggtctttttgcatcgcttggcatggtcgcagcatccttttgtagatcgattattcaagtgtacctcaccactggtgtgattactggtctgggtctggcgctgaattttcagccatccctcattatgcttaaccgctatttctccaagagacgtccaatggcaaacggactcgcagcagctggaagccccgtctttctttgtgcactctcacctttgggacagcttctccaggatcggtacggttggaggggcggtttcttgattctgggcggattgcttcttaattgctgtgtgtgcgccgccctcatgcggccccttgtcgtgactgcacagccaggttctggtcctccccgcccatcgcgcagactcttggatctttcggtgtttcgggacagaggcttcgtgctgtacgccgttgcagcatcggtgatggtgctgggactctttgtgccgcccgtgtttgtggtttcatacgctaaggatctcggagtcccggacaccaaagcggctttccttcttaccatccttggtttcattgacatattcgctagacctgcagctggctttgtcgccggactgggaaaagtcagaccttactcggtctacctgttctccttttccatgtttttcaacggcctggcagatctggctggctccactgccggagattacggaggccttgtggtgttctgcatcttttttgggatctcgtacggtatggtcggcgcactgcaattcgaggtgcttatggctattgtaggaactcataagttttcgagcgctattggacttgtactgttgatggaggcagtggcggtcctggtgggaccacctagcggtggaaagctgctcgacgccacccatgtctacatgtacgtgtttatcttggctggagccgaagtgctgacctcctcccttattctgctgctgggcaactttttctgcattcggaagaagcctaaggaaccacagccggaagtcgcagctgcagaagaagaaaagctccataagcctccagcagactcaggagtggatctcagagaagtggagcattttcttaaggcagaacctgaaaagaacggggaagtggtgcacactcctgagacttcggtg

SEQ ID NO: 33753 - DNA, 1395 bp, Artificial Sequence
  Description of Artificial Sequence: Synthetic coding sequence
atgggaggtgctgtggtcgatgaaggtcccaccggggtgaaggcccctgacgggggctgggggtgggctgtgctttttggttgttttgtgatcactggtttctcttacgccttccccaaagctgtgagcgtgtttttcaaggaattgatccaagaatttggcattggatatagcgacacagcctggatcagctccattctacttgcaatgctgtatggtacaggccccctgtgctccgtttgtgtgaaccgcttcggttgcaggcccgtcatgcttgtggggggactcttcgcctctctgggaatggtagctgcctcattttgcaggagtataatccaggtgtacctcactacaggcgtcattacagggctgggtctcgccctcaactttcagccaagcctgattatgctgaacaggtacttctccaagcgccgtccaatggctaacggcctggcagccgctgggtcaccggtttttctctgtgctctgagccccctcggccagctgctgcaggaccgttacggctggagaggaggctttcttatactgggcggtctgctcctcaattgttgtgtttgcgccgcactgatgaggcctctggtcgtgaccgcccagcccggctcaggcccgccgcggcctagtagaagattgctggatctgagtgtgttcagagaccggggattcgttctctacgctgttgcagcaagcgtcatggtgctgggattgtttgtaccacccgtgtttgttgtgtcatacgccaaagatctcggtgtgcccgataccaaagcagcttttctcctgactatcctgggatttatagacattttcgcccggccagctgccgggttcgtcgccggtctcggcaaagtcaggccctattctgtgtatttattctcattttcgatgttcttcaatggattagccgacctcgcagggtctactgctggagactacggggggctggtagtgttttgtattttctttggaatttcatatggcatggtcggggcactgcagttcgaggttcttatggccatagtcgggacgcataaatttagttcggctattggtctggtgcttttgatggaagcggtggccgttttggtgggaccaccgtctggaggcaagctgctagacgcaacccacgtgtatatgtatgtgttcatcctagctggtgcggaggtgctcacaagcagcctgatcctcctactcgggaacttcttctgtattcgcaaaaagcccaaggagccccagcccgaggtcgctgccgcagaggaggagaagttgcacaaacctccggctgattctggggtggacctgagggaggtagaacacttcctgaaggcggaacccgagaagaacggggaagtggtgcatacccctgagacgagcgtc

SEQ ID NO: 33754 - DNA, 1395 bp, Artificial Sequence
  Description of Artificial Sequence: Synthetic coding sequence
atgggaggcgccgtggtggacgaaggacccaccggagtcaaggcgccggacgggggttggggctgggccgttctgttcggatgtttcgtcatcaccggattctcatatgcgttccctaaagcggtatccgtgttcttcaaagagctcattcaagagttcggtatcggctactcagataccgcttggatctctagcatcctcctggccatgctgtatggaactggtccgctgtgtagtgtgtgcgtgaataggttcggttgccggcctgtgatgctggtggggggactgttcgcttcactgggtatggtggccgcgtccttttgccggtcgattattcaggtctacctgactacgggggtgatcacgggactgggcctcgcactgaacttccaaccctcgctcatcatgctcaacagatacttctccaagaggcgcccgatggcaaacggactggctgccgcgggttcaccggtgtttctgtgtgccctgagcccgctcggacagctccttcaggaccggtacggttggcgcggcgggttcctgatcttgggagggctgctgcttaattgctgcgtttgcgcagccctgatgcgtcctctcgtcgtgaccgctcagcctggatcggggccgccaaggccgtcccggcgcctcctggacctgtcagtgttccgggacagaggattcgtcctgtacgccgtggctgcttctgtcatggtgctcggattgtttgtcccacccgtgtttgtcgtgagttacgcaaaggacctcggcgtcccagacacgaaagccgcatttttgcttaccatcttgggattcatcgatatctttgctcgcccagctgcgggatttgttgccggactggggaaagtgcgcccctactcggtctacctcttctccttcagcatgttctttaatgggctcgccgacctggcaggatcgaccgcgggagattacggaggtttggtggtgttttgcatcttcttcggaatttcgtacggaatggtgggcgccctgcagttcgaagtgctcatggcgattgtgggaactcacaagttcagttcagctatcggcttggtgcttctgatggaggctgtggcggtgctcgtcggtccaccttccgggggaaagctcctggatgcgacccacgtctacatgtacgtgttcatcctggccggcgccgaagtgctgacttcgtcccttatcttgctcctgggcaacttcttttgcattcggaagaagccaaaggaaccgcaaccggaggtggccgctgcggaagaggaaaagctccataaaccaccggccgattcgggagtggaccttcgggaagtggagcatttcctcaaagcggaaccggagaagaacggagaggtcgtacacaccccggaaacttcggtg

SEQ ID NO: 33755 - DNA, 1395 bp, Artificial Sequence
  Description of Artificial Sequence: Synthetic coding sequence
atgggaggcgcagtcgtggatgaaggaccgactggggtcaaggccccagacggcggatggggttgggcagtcctgtttggatgttttgtgattactggtttttcctatgcattcccaaaagcagtgtcggtgttctttaaggaactcattcaagagtttggaatcggttactcggatactgcgtggatttcctcgatccttctggcgatgttgtacggtacgggccctctctgctctgtgtgtgtgaaccgatttggttgtaggcctgtcatgctggtgggaggtcttttcgcctctcttggtatggtggccgcctccttttgcagatccataattcaggtgtatctcactacgggggttattaccggattgggcctggcactgaacttccaaccatcgctcattatgctcaataggtacttctcgaagagacgaccaatggctaacgggcttgccgcggcagggtcacccgtgttcctgtgtgccctctcgccactgggacaactgctgcaggatagatacggttggcgaggcggatttctgattctggggggacttctgctgaactgttgtgtctgcgcggcactgatgcggccactggtggtcactgcacagcccggcagcggacctcccaggccttcccggagacttcttgacctcagcgtgttcagggataggggcttcgtgctttatgcagtcgccgcgtcggtcatggtgcttggcctgtttgtgccccctgtgttcgtggtgagctacgcaaaggatcttggcgtcccagataccaaggccgcatttctgttgaccattctggggtttatcgacatttttgcacgtccagcagcaggatttgtcgctggccttggaaaggttcggccctactccgtgtatctgttttcgttttcaatgttcttcaacgggttggcagatcttgccggatccaccgcaggtgattacggtggacttgtggttttctgtatcttttttggcatctcgtacggaatggtgggtgctttgcagtttgaggtactgatggctattgtgggaactcacaagttctcctccgcaatcggccttgtgcttctcatggaggcagtggcagtgcttgtgggaccgccatcgggaggaaaacttcttgacgcaacccatgtgtacatgtacgtgtttatactggcaggcgccgaggtgcttacgtcctcgctgatcctgcttctggggaatttcttctgtatcagaaagaagccaaaggaaccacaacctgaggtggcagctgctgaagaagaaaaactgcataagccgcctgcggattccggggtggacctgagagaagtggaacatttccttaaggcagaaccagagaagaatggtgaagtggtacatactcctgaaacgagcgtc

SEQ ID NO: 33756 - DNA, 1395 bp, Artificial Sequence
  Description of Artificial Sequence: Synthetic coding sequence
atgggcggtgccgtggtcgatgaagggccgaccggggttaaggcccctgatgggggatggggttgggctgtgctgttcggctgcttcgtgatcactgggttcagctacgcgttcccgaaggctgtctccgttttcttcaaagagttgattcaggagtttgggattggttactcggacaccgcctggatctcgtccattctcttggcaatgctgtacggaacgggcccgctctgctccgtgtgcgtcaatcggtttggatgtcgaccggtgatgctggtcggaggcctcttcgcgtcactcggtatggtggcagcctccttctgccgctcaatcatccaggtgtacctcactactggagttattactggactcgggttggccctgaactttcaaccgagcctcatcatgctgaacagatacttttcaaagaggcgcccgatggccaacggactggcagccgcaggatcgccggtgttcctgtgcgcactgtccccgttgggtcaactcctccaggacagatacggatggagagggggattccttatcctgggaggccttctgctcaactgctgcgtgtgcgctgccctcatgcgcccacttgtagtgactgcacagcctggatcaggacctccacggccttcgcgcagactgctcgacctgtccgtctttagggatagaggatttgtgctgtacgcagtcgcggcttccgtgatggttcttgggctgttcgtgccacctgtgttcgtggtatcgtacgccaaggacctgggagtgccggacaccaaggcggccttcctgttgacgatcctgggctttatcgacatcttcgcgcgcccagcggccggcttcgtcgcaggcctgggtaaggtgcggccgtactcggtgtaccttttcagcttctcaatgtttttcaatggactggcggatctcgcgggcagcactgcaggggattacggagggctggtcgtgttctgcatcttttttggcatctcgtacggcatggtgggcgccctgcagttcgaggtgctgatggctatcgtgggaactcataagttctcctcggcaatcggcctggtgctgcttatggaggctgtggctgtgctggtcggacctccgtccggaggaaaactgctcgatgcaactcacgtctacatgtacgtgttcatcctggctggtgcggaagtgctgacctcgtccctgattctgctcctgggcaacttcttctgcatccgcaaaaagccgaaggagccccagccagaagtggccgctgccgaagaagaaaagctccataaaccaccggccgattcaggcgtcgacctgcgggaggtcgaacattttctgaaagcagaaccagaaaagaatggcgaagttgtgcacaccccggaaacgtccgtc

SEQ ID NO: 33757 - DNA, 1395 bp, Artificial Sequence
  Description of Artificial Sequence: Synthetic coding sequence
atggggggagccgtcgtggacgaagggcccacgggcgtaaaagcacccgatgggggttgggggtgggccgttttgttcggctgtttcgtaattacgggctttagctatgcttttcccaaggcggtcagtgtgttcttcaaggagctgatccaggagtttgggatcggttactccgacacggcatggatttcgagcatcctcctggccatgctgtatggaacaggacctctttgctcagtctgtgtgaatcggttcggatgtcggcccgtgatgctcgtgggggggctctttgcttcactcggaatggtggctgcctccttttgccggtccatcatccaggtgtacctgactacaggcgtcattacaggattgggacttgcactcaactttcaaccatctctcatcatgttgaaccgatacttctctaaacggagaccgatggccaatgggctagcagccgcagggtcccctgtattcctctgcgccttgagccctttggggcagctactacaggatcgatacggctggcgaggggggttcctgatacttggcggactgctgcttaactgctgtgtctgtgctgctctgatgcggccactggtggtaactgcccaacctggctcaggaccaccccgtcctagccggcgccttcttgacctcagtgttttccgcgacaggggctttgttctctatgcggtcgcagcctccgttatggtcctggggctttttgtcccacctgtgttcgtagtcagctacgccaaggacctcggtgttccagacaccaaagctgcttttttgctaacgatcctcggtttcattgatatatttgctcgcccagccgccggtttcgtcgcggggttgggaaaggtgcgcccttactctgtgtatctgttttccttttcaatgttcttcaatggactggctgacctggccgggagcacagccggcgattatggtggacttgtagtgttctgcatcttttttgggattagctatggaatggtgggcgctttgcaattcgaggttctgatggcaattgttggaactcataaattttcctccgccatcggactcgtcttgctgatggaggctgtggcggtcctcgtgggccccccctccggcggcaagctgctcgatgccacccatgtgtatatgtacgtgtttattctcgccggagcggaagtcctcacatcttccctgatactgctcctcgggaacttcttttgtatcagaaagaagcctaaggaaccacagcctgaagttgccgctgcggaagaggagaaacttcacaagccaccagccgactccggagtggacttgagagaggttgaacatttccttaaagctgagccagagaagaatggagaggtggtgcatacaccagagaccagtgtc

SEQ ID NO: 33758 - DNA, 1395 bp, Artificial Sequence
  Description of Artificial Sequence: Synthetic coding sequence
atgggcggggccgtggtcgatgagggaccaaccggagtcaaggcgcctgatggcggctggggctgggccgtgctgttcggatgtttcgtcatcactgggttcagctacgcatttccgaaggctgtgagcgtgttctttaaggagctcatccaggagttcggaattggttactcagacactgcttggatttcctcaatcctgctcgcaatgctttacggcactggaccactgtgctccgtctgtgtgaaccggtttggatgccggcctgttatgctggttggtggcctcttcgctagcttgggaatggtcgcggcttccttttgtcggtccatcatccaagtgtacctcactaccggcgtgataaccggcctgggcctggccctgaacttccagccgagcctgatcatgctcaatcggtacttttcgaagcggcggccgatggccaacggtctggcggcggctggctctccagtgttcctctgcgccctgagcccgttgggtcagctcctccaggacaggtacggttggagaggtggtttccttatcctgggaggcctgttgctgaactgctgtgtgtgcgccgcgctcatgaggcctctcgtcgttacggcacagccaggtagcggacctccacgcccgtccaggaggctgctggacctctcagtctttcgggaccggggctttgtgctgtacgccgtggcggcctcggtgatggtgcttggtctgttcgtgccgcccgtgtttgtggtatcgtacgctaaggatctgggagtgcctgacactaaggcggcgttcctgctgaccatccttggctttatcgacatctttgcccgcccggctgccgggtttgtggcaggattgggaaaggtgcggccctactccgtgtacctgttcagcttctcgatgttctttaatggtctggcggacctcgccgggtccaccgccggggattacggaggacttgtcgtgttttgcatcttctttgggatctcgtacggaatggtgggggcattgcaattcgaggtgctcatggcgattgtcggtactcataagttctccagcgcgatcggtctggtgctgctgatggaggcggtggctgtgttggtgggaccgccatcgggaggcaagctcctcgacgcgacccacgtgtacatgtacgtgttcatcctcgcgggagcagaggtgttgaccagctcgctgatccttctgctgggcaacttcttctgcatccgcaaaaaaccgaaagagcctcagcctgaggtggctgcagccgaagaagaaaagctgcacaagccaccagcagattccggcgtcgacctgcgtgaagtcgaacatttcctgaaagccgagccggagaagaacggggaagtggtgcacactccggaaacctccgtc

SEQ ID NO: 33759 - DNA, 1395 bp, Artificial Sequence
  Description of Artificial Sequence: Synthetic coding sequence
atgggaggagctgtggtggacgaggggccgacgggcgtgaaagccccggatggtggatgggggtgggctgtcctgttcggttgcttcgttatcaccggctttagctacgcttttccgaaggcggtgtctgtgttctttaaggaactcatccaagaattcggaatcggctactcggatactgcctggatctcgagcatcttgctggctatgctctacggaactgggccgttgtgttcggtgtgtgtgaaccggttcggatgccggcctgtgatgctggtcgggggcctgtttgcgtccctcggaatggtggcagcgagcttctgtcggtccatcatccaggtgtacctcactaccggagttatcaccggacttgggctggccttgaatttccagccatccctgatcatgttgaatcgctactttagcaagcgccgcccgatggccaacgggctcgcagcagccggctcgcccgtgttcttgtgcgccctgtccccactgggacagctgttgcaggatagatacggctggcgcggaggatttctgatcttgggtggactgcttctgaactgttgcgtgtgcgcagccctgatgcgccccctggtggtgacggcccagccgggatccggtccgccaaggccgtccaggcgcctgcttgacctctccgtgttcagagatcggggattcgtgctctacgcggtggcagcctcggtcatggtgctgggactgttcgtcccgcccgtgttcgtggtgtcgtacgcgaaagacctcggtgtgccggataccaaggccgctttcctgctgactatcctggggtttatcgacatttttgctagacctgcggcgggtttcgtggctggactcggaaaagtcagaccgtactcagtgtatctctttagctttagcatgttcttcaacggtctggccgatttggctggctcaactgcgggagactacgggggactggtcgtgttctgcatcttcttcggtatttcgtacggtatggttggagccctgcaattcgaagtgctgatggccatcgtgggcacgcacaaattctcctctgcgatcgggttggtgctccttatggaggccgtcgctgtcctggttggcccaccgtcaggtggtaagctgcttgacgcgactcatgtctacatgtatgtgttcatcttggctggcgctgaggtcctcactagcagcctgattctgctgttgggaaatttcttttgtatccggaagaagccgaaggagccacaacctgaagtggccgcggccgaggaagaaaagctccacaaaccaccggcagactccggtgtcgacctccgagaggtcgagcatttccttaaggcggaaccagaaaagaacggagaggttgtgcacactcctgagactagcgtg

SEQ ID NO: 33760 - DNA, 1395 bp, Artificial Sequence
  Description of Artificial Sequence: Synthetic coding sequence
atgggcggcgccgtcgtggatgaagggccgactggggtgaaagcgcccgacggtggctggggctgggcagtgcttttcgggtgctttgtgatcaccggattctcctatgcattccctaaggccgtgtccgtgtttttcaaggagcttatccaagaatttgggatcggctactcggataccgcctggatttcctcgatcctgctggccatgctgtacggtaccggaccgctgtgttcggtgtgtgtgaaccggttcggatgccgtccggtgatgttggtgggaggactgttcgcctcgctcgggatggtggccgcatcgttctgcaggtcaatcatccaggtctacctcactaccggcgtgattactggtttgggtcttgcactgaatttccagccttcactgatcatgctcaacagatacttcagtaagaggcgccctatggcgaatggcctcgcggccgcgggatcaccggtgtttctctgcgcgcttagccccctgggacagctcttgcaggataggtacgggtggagaggtggattcctcattctgggcggccttctgctgaactgctgcgtgtgcgcggccctgatgcgccccctcgtggtcaccgctcaaccaggatcgggccccccacgcccttcgcgccgactgctggatctttccgtgttccgcgacaggggattcgtgctgtacgccgtcgcggcgagcgtcatggtgctgggactttttgtgccgccggtgtttgtggtgtcgtacgctaaggacctgggcgtgccggacactaaggcggcctttctgctgaccattctcggtttcatcgatatcttcgcacgacctgccgcgggattcgtcgcaggattggggaaagtcagaccatactccgtgtacttgttctcattttccatgttcttcaacggcctcgctgacttggcggggtcgacggctggggactacggtggcctcgtcgtgttctgcatcttctttggaatttcgtacggtatggtcggcgctcttcagttcgaagttctcatggcaatcgtcggtacccacaaattctcgtccgcgatcggactggtcctgttgatggaagcggtcgctgtgctggtggggcctccatccggaggtaaactcctggacgctactcacgtttacatgtacgtgttcatcctggcgggagcggaagtgttgacgtcatcgctgatcctgctgctcggtaacttcttctgcattagaaaaaagccgaaagaaccgcaaccggaagtcgcagcggcggaggaagagaagttgcataagccaccggccgattccggcgtggatcttcgggaggtcgagcacttcctgaaagccgagccggagaagaacggagaagtcgttcatacccccgaaacctccgtg

SEQ ID NO: 33761 - DNA, 1395 bp, Artificial Sequence
  Description of Artificial Sequence: Synthetic coding sequence
atgggaggagccgtcgtggacgagggtccgacgggcgtgaaagctccggatggcggttggggttgggccgtgctcttcggctgttttgtgattaccgggttctcgtacgcgttccccaaagcagtgtccgttttcttcaaggaactcatccaggaatttgggatcggctactcggacactgcgtggatctcgtcgattctgctggccatgctgtacggaactggccctctgtgttccgtttgcgtgaacaggttcggatgccggccagtgatgctcgtcggaggcctgttcgcctcgcttggaatggtcgcagcctcgttttgcagaagcatcatccaggtgtatcttaccaccggagttatcactggtctgggcctggccctcaacttccaaccgtcactgatcatgttgaatcgctacttcagcaaacggcggccgatggcaaatggactggccgccgccggaagccccgtctttctttgcgccctgagtccgttgggacagctgctgcaggacagatacggctggaggggaggctttttgatcctcggaggattgctgctgaattgctgcgtgtgtgctgcactgatgcggccgctggtcgtgactgcgcaaccgggatcgggtccgccgaggccatcgagacggctgctggatctcagcgtctttcgggacaggggattcgtcctctacgccgtggcagcatccgtcatggtgctgggcctttttgtccctccggtgttcgtggtgtcatatgccaaggatcttggagttcctgacactaaagccgccttcctgttgaccatcctgggcttcatcgatatcttcgccaggcctgctgcaggttttgtggccggactgggaaaggtgcgcccgtacagcgtgtaccttttctcattcagcatgttctttaacgggctcgctgacctggctggctccaccgcgggagattacggcgggctcgtggtgttctgcatcttcttcggaatctcttacggaatggtgggggccctccagttcgaagtgctcatggctatcgtgggcacccacaagttcagctcggctatcggtttggtgctgctgatggaagcagtagccgtgctggtcggcccaccctccggcggaaagctcctggacgcgactcacgtctacatgtacgtgttcatccttgcgggtgcggaagtgctcacgtcgtccctgatcctcctgctgggtaatttcttctgcatccgcaagaaacctaaggagccgcagccagaggtggcggccgccgaggaggagaaacttcacaagccaccagctgattccggggtggacctgcgcgaggtggagcacttcctcaaggccgaacccgagaaaaatggagaagtggtgcacactcctgagacttccgtg

SEQ ID NO: 33762 - DNA, 1395 bp, Artificial Sequence
  Description of Artificial Sequence: Synthetic coding sequence
atgggtggagcagtggtggatgaaggtccaactggcgtgaaggctcccgacggcggttggggatgggcagtgctctttggctgcttcgtgattaccgggttctcatacgcatttccaaaggctgtgtcggtgttctttaaggaacttatacaagagtttggaattgggtattcagatactgcgtggatttcctccattctcctcgcaatgctttacggcaccgggcctctttgtagtgtctgcgtgaatcgatttggctgtagacctgtgatgctcgtgggcggtctttttgcatcactcggaatggtcgcggcatccttttgcagaagcatcattcaagtctaccttacgaccggcgtgatcaccggactgggtctggcacttaacttccaaccttcgctgataatgctgaaccgctactttagcaagcgaaggccgatggccaacggactcgcggcagccggatcccctgtattcttgtgtgcactttcgccactcggccagctccttcaagacaggtacggatggagagggggctttctcattctgggaggcctcctgttgaattgttgtgtgtgtgccgcactcatgcgccctttggttgttaccgctcagccaggtagcggaccaccaagaccttcgaggagactccttgatctctcggtgttccgggatcggggattcgtgctttacgccgttgcagcatcagtgatggtgttgggactgttcgtgcccccggtttttgtggtgagctacgcaaaggatctcggagtccctgacaccaaagcagcgtttctcttgactatcctgggatttatcgacatctttgcccgtcctgccgcaggctttgtagcaggcctgggaaaggtcagaccttactcggtgtatcttttctcgtttagcatgttctttaatgggctggcagacctggcaggtagcaccgcgggcgactacggaggtcttgtggtcttttgcatcttttttggtatatcgtacggtatggtaggagcactccagtttgaagtccttatggccattgtgggaactcacaagttcagctcagcaatcggactggtccttttgatggaagccgtggcggtccttgtggggccaccgtccgggggaaaattgctggatgccactcatgtctacatgtacgtattcattcttgcaggagctgaagttttgactagctccctcattttgctgcttggtaacttcttctgtataaggaagaagcccaaggaaccacagccggaggttgcagccgctgaagaagagaaacttcataaaccacccgccgattccggggtggatttgcgggaggtcgagcactttcttaaagcagaaccagagaagaacggggaagtggtgcatacccctgaaacgagcgtg

SEQ ID NO: 33763 - DNA, 1395 bp, Artificial Sequence
  Description of Artificial Sequence: Synthetic coding sequence
atgggaggggctgtcgtcgacgaagggccaaccggcgtgaaggctcccgacggcggatgggggtgggcagtactgttcggctgctttgtcatcactgggttttcatacgcctttcctaaagccgtcagcgtgttctttaaggaactgatacaagaattcggaatcggttatagcgatacagcatggatatccagtatcctgctggccatgctctatgggaccggaccactctgttcagtttgcgtcaatagatttggatgccgacctgtgatgctggtcggcggtctcttcgcctccctgggaatggtagccgctagtttttgtcggtccatcatccaagtgtacctgaccacaggcgttattaccggacttggccttgccctgaatttccagccgtcgttgattatgctcaataggtatttttcaaaacggcgccccatggcaaatgggctagcagctgcgggatctcctgtttttctgtgtgctctgagccctctcgggcagctgctgcaggacaggtacgggtggcggggcggcttccttatcctggggggtctcctgctgaactgttgcgtgtgtgcggctctcatgcggcctctggttgtgacggctcaacccggctcaggccctcctcggccgagcagacggttgttggacctgtccgtgtttcgggaccgggggttcgtgctttatgctgtggctgcatccgtaatggttctgggtctgtttgtcccgcctgtgtttgtagtaagctatgccaaggacctgggcgtgcccgatacaaaagcagccttcttgctgacaatcctggggttcatcgacatcttcgcccggccggccgctggattcgtggcaggcctggggaaggttcgcccatactccgtgtaccttttttctttttctatgttctttaatggcctggctgatctcgccgggtctacagcgggcgactacgggggtcttgttgtattctgcattttctttggcatatcttacggaatggtaggcgccctacagtttgaagtattgatggctatcgtcggtactcacaaattcagtagcgctatcggactggtcctgctgatggaagcagtggccgtgttggtcggcccgccttccggagggaagcttttggatgctacccatgtctatatgtacgtgtttattctggcaggcgccgaagttctaacttctagcctgatcctcctgctgggtaactttttttgcattagaaagaaaccgaaagagccccagccagaagtggcggcggctgaagaagaaaaactccataagccgccagcagactcaggcgtggatctaagggaagtggaacacttcctgaaggcggagcctgagaagaatggcgaggttgtgcatacgccagaaactagcgtg

SEQ ID NO: 33764 - DNA, 1395 bp, Artificial Sequence
  Description of Artificial Sequence: Synthetic coding sequence
atgggtggcgcagtggtggatgaaggacccactggtgtgaaggcgcctgacggtggttggggttgggcagtactttttggatgtttcgtgatcactggattctcttatgcgtttccaaaagctgtgtccgtgttctttaaggaactgattcaagaatttggaattggctactcggacaccgcatggatttcttctatcttgcttgcaatgctctacggaaccggtcctctctgctcggtgtgcgtgaatagattcggctgccgcccagtgatgctcgtcggaggactgttcgcatcactgggtatggtggcagcatcattttgtcggagcattatccaggtctaccttaccaccggagtgatcactggcctcggtcttgccctcaactttcaaccatctcttatcatgctcaatagatacttttccaaacgtagacctatggcaaacggactcgccgcagctggatcaccagtctttctgtgcgcgctgtcgccactgggtcaacttcttcaagacagatatggctggaggggcggctttctcatcctgggcggacttcttcttaactgttgtgtgtgtgcggccctcatgcggcctctggtcgtgaccgcacagccagggtccggccctccaagaccatcccgccggttgcttgatttgtccgtgttccgcgatcggggatttgtgctttacgcagtcgcggcatccgtcatggtgcttggactgtttgtccctcccgtttttgtggtgtcctacgccaaggaccttggggtgccggataccaaagccgcattcctgcttactattctcgggtttattgacatttttgcaaggccagccgcaggatttgtggcgggtctgggtaaggttcgaccttactcggtgtacctcttttcgttctcgatgttcttcaacggtcttgcagatctcgctggctccaccgcaggagattacggtggtctggtggtcttttgtatattcttcgggatatcatacggtatggtgggtgcacttcagtttgaggtgctcatggccattgtcggtactcataagtttagctcagcgattggactggttcttctcatggaagccgtggcagtcttggtcgggcccccgtccggaggtaaactccttgatgccacgcacgtctacatgtacgtgtttatactcgcgggggcagaagtgctgacctctagcctcatcctcctccttggcaactttttctgtattagaaaaaagccgaaggagccccagcccgaagtcgctgcggcggaggaggaaaagttgcacaagcctccagccgactctggcgtggatcttcgtgaggtggaacactttctcaaggccgaacccgaaaagaatggtgaagtggttcatacgcctgagactagcgtc

SEQ ID NO: 33765 - DNA, 1395 bp, Artificial Sequence
  Description of Artificial Sequence: Synthetic coding sequence
atgggaggcgctgttgttgacgagggacccacaggcgtgaaagcacccgacgggggatggggatgggccgtgctcttcggatgctttgtgattacagggttctcttacgcattccccaaggctgtcagtgtttttttcaaagagttgatccaggagtttgggatcggatactcagacactgcatggatttctagtattctgctcgctatgctttacggcacgggaccgctgtgctctgtctgcgtgaatcgctttggctgtaggcctgtgatgctggtgggaggcctatttgcctccctgggtatggtcgcagcttcattttgccggtcaattatccaggtataccttaccacgggggtcatcactggtcttggactggccctgaattttcaaccatccctgataatgctcaataggtacttctccaagcgccgtcccatggcaaacggcttggcggcagcgggatcccctgtcttcctctgtgccctctcgccacttgggcaactgctgcaagacaggtacgggtggaggggggggttcctgatcctcggagggctgcttctgaattgctgtgtttgtgccgccctgatgagaccactcgttgtaaccgcacaacctggtagtggaccacctaggccttccagaagacttcttgacctctctgtgtttagagaccgtgggttcgtgctgtacgcggtggcagcatcagtcatggtgctgggcctgttcgtccctcccgtcttcgtggtatcgtacgccaaagacctgggggtccccgacactaaggccgccttcctcctgaccattctgggcttcatcgacatttttgccaggcctgccgcaggctttgtggctgggctcggaaaagtcaggccctactcagtgtatctcttctctttctctatgtttttcaacggcctcgccgacctcgcgggctctactgccggtgattacggcggactggtcgtgttctgcattttttttggcatttcatacggaatggtaggggccctccaattcgaagtgctgatggccatcgtagggacccataagttctccagtgcaattggcctggttcttctcatggaggcggtcgctgtgttagtgggacctccttctggaggtaagctactcgatgccactcacgtgtacatgtacgtttttatactggccggcgctgaggtgcttacatctagcctcatactgctcctggggaactttttttgtatcagaaaaaagcctaaggagcctcagcctgaggtcgcagcagcagaggaggaaaaactacataagccgcccgccgacagcggggtggacctgagggaagtggaacactttttaaaagcagagcctgagaaaaatggggaggtcgtccatacccccgaaacatctgtc

SEQ ID NO: 33766 - DNA, 1395 bp, Artificial Sequence
  Description of Artificial Sequence: Synthetic coding sequence
atgggaggagcagtcgtcgacgaagggccaactggtgtgaaggcccctgatggcgggtggggatgggccgtgctctttgggtgcttcgtgatcactgggttctcctacgctttccccaaagcagtctcagtgttcttcaaggaactcatccaagaatttggaatcgggtactcggatactgcatggatttcgtcaatcttgctggccatgctgtacggcaccggaccactgtgctcagtttgcgtgaaccgctttggatgcagaccggtcatgctggtcggcggattgttcgccagcttgggaatggtggccgcctcattttgccggtcgattatccaagtgtacctcactaccggagtgattaccggtctggggctcgcgctgaatttccaaccgtccctgatcatgttgaaccgctacttctcgaagcgccggccgatggccaacgggctggcagccgccggatcgccagtgtttttgtgcgctctgtcaccactcggacagctgctccaggatcgctacggttggcggggaggattcctgatactgggcggattgctgcttaattgctgtgtgtgcgccgccctgatgaggcctctggtggtgaccgctcagcctggatcgggtcctccaaggccttcaaggcggttgctggatctctccgtgttccgggaccgcggattcgtgctttacgccgtggctgcctcggtcatggtgctggggctttttgtgccgccagttttcgtcgtcagctacgctaaagatttgggtgtgccagacaccaaggccgccttcctgctcactatcctcggcttcatcgacattttcgcccggccagcggcgggatttgtcgccggactgggtaaggtgcggccctactcggtctacctgttttccttttccatgtttttcaacggactggctgacctcgctgggagcaccgcgggagactacggagggttggtggtgttctgcatctttttcggcatctcgtacggaatggttggagcccttcagttcgaagtccttatggcaatcgtcggtacccacaaattctcctcggcgatcgggttggtgttgctgatggaagccgtcgcagtgctggtgggaccaccgtcgggcgggaagctgctggacgcgacccatgtctatatgtacgtgttcattctggctggcgcggaagtgctcacctccagtttgatcctgctgctggggaactttttctgcattcgcaaaaagcctaaagaacctcagccggaagtcgctgcggccgaggaggaaaagctgcacaaacctccggccgattccggagtggatctgcgggaggtcgaacatttcctcaaggcggagccggaaaagaatggagaggtggttcacacgccggaaacttctgtg

SEQ ID NO: 33767 - DNA, 1395 bp, Artificial Sequence
  Description of Artificial Sequence: Synthetic coding sequence
atggggggagctgttgtggacgaagggccaacaggggtcaaggccccagatggtgggtggggttgggctgtgttgttcggttgtttcgttataaccggtttcagttatgcatttcccaaggccgtgagcgtcttctttaaagagttaatccaagagtttggtataggttactccgatactgcttggatcagcagtattttgctcgcaatgttatacggtacaggtcctctttgctcagtttgtgtcaatcgcttcggttgtagaccagttatgctcgttggtggacttttcgcaagtcttgggatggttgccgcttctttctgtaggagcataatacaggtttacctaaccaccggtgttataactggccttggactagctttgaatttccaacctagtcttataatgcttaaccggtactttagcaagaggcgacctatggccaacggattggcagcggccggtagccctgttttcctttgcgccttatcccctttaggtcagctcctgcaagacaggtatggctggcgtggtggatttctgatcctgggtggtttattacttaattgttgcgtctgtgctgctttgatgcgccccttggtggttaccgcccagcctggttctggcccaccaaggcccagccggcgtctgctcgatctttcagtgttccgagatcgcggtttcgtcctttatgccgttgcagcgtcagtgatggtgttgggacttttcgttccaccggtgtttgttgttagctacgcaaaggacctgggagtgcccgatactaaggcggcttttttgttaacaatcctcggatttatcgatatatttgctaggcctgccgctggtttcgtagccgggcttggtaaagttagaccttattctgtgtatcttttctccttctctatgttttttaatggattggcagatttggctggctctactgcaggagattatggaggattagtcgtcttctgtattttctttggtatctcctacggtatggtcggagctctccaattcgaagttttgatggctatcgtaggtactcataagttttcgtcggccattggactggtgcttctgatggaggctgtagcagtactcgttggtcccccttcgggcggtaagttgttagacgcgacacatgtttacatgtatgtgttcattttagcaggtgccgaggtgctaacttcttcactaattttattgcttggtaactttttctgcattcgaaagaaacccaaggagccccaacccgaagtagccgcggccgaggaggaaaagcttcataaaccacctgctgattcgggtgttgacttaagagaggtggaacattttctcaaggccgagcccgaaaaaaacggcgaggtggttcatacgccagagacctcagtt

SEQ ID NO: 33768 - DNA, 1395 bp, Artificial Sequence
  Description of Artificial Sequence: Synthetic coding sequence
atgggtggtgccgtggttgacgagggcccgactggcgtgaaagccccagacggcggatggggctgggccgtcctgttcggatgcttcgtgattactggtttctcgtacgcattcccgaaggccgtgtccgtgttcttcaaagagctgatccaggaattcggcatcggatactctgataccgcatggattagctcgatcttgctggccatgctgtacggaaccgggccgctttgctcggtgtgcgtgaatcggttcggatgccggccggtgatgctggtcggaggactgtttgcctcgctgggcatggtcgctgcatccttctgccgctcaatcatccaagtgtacctgactactggcgtcatcaccggactcggattggcgctcaactttcaaccgtcattgatcatgctgaaccggtacttctcgaagagacggccgatggctaacggactggcggctgcgggatcgccggtgttcctctgcgctctttcgccgctgggacagctgctgcaggaccgctacgggtggagagggggattcctgatcctcggaggactgctcctgaattgctgcgtgtgcgctgccctgatgaggccactggtcgtgaccgctcaaccgggatcaggacctcccagaccgtcccggcgcctgctggacctgagcgtgtttcgagacagaggttttgtcctctacgccgtcgccgccagcgtgatggtgctgggactcttcgtgcccccagtgttcgtggtcagctacgccaaggatctgggagtgccggatacgaaggcggcatttctcctcaccatcctgggatttatcgatatcttcgcgcgcccggccgccggtttcgtcgctggactcggaaaagtgcgcccctactcggtgtacctgttctcattctctatgtttttcaatggactcgccgacctggctggctccaccgccggcgattacggtggacttgtggtgttctgcattttctttggcatcagctacggaatggtgggagctctgcaattcgaggtcttgatggcaatcgtgggtactcataagttttcatcggcgatcggactcgtgctcctgatggaagccgtggccgtgctggttggacccccgtcaggagggaagttgctcgacgcaactcacgtgtacatgtacgtgttcatcctcgcaggcgccgaggtgctcacctccagcttgattctgctgctcggaaacttcttctgcatccgcaaaaagccgaaggagccacagcccgaagtggctgcggctgaggaagagaagctgcataagccgccggccgactcgggagtggacttgagggaagtggaacatttcttgaaagcggagccggaaaagaacggagaggtggtgcacaccccggaaacttcagtg

SEQ ID NO: 33769 - DNA, 1395 bp, Artificial Sequence
  Description of Artificial Sequence: Synthetic coding sequence
atgggaggagctgtggtcgacgagggaccgactggagtcaaggccccggacggtggctggggatgggctgtcctgttcggatgtttcgtcatcactggcttttcctacgcatttccgaaggctgtgtccgtgttcttcaaggagctcatccaagagtttgggatcggctactcggacaccgcgtggatcagcagcatccttctggccatgctctatggcacgggcccgctgtgctccgtgtgtgtgaaccgatttggttgtagaccggtcatgcttgtgggaggactcttcgcctcgctgggaatggtcgcggcgtcattttgcagatctatcatccaggtgtacctcaccacgggagtcatcaccggcctcggactggccctcaatttccaaccatcactgatcatgctcaataggtacttttcaaagcggcgccctatggccaacgggctcgcggccgcgggctcacctgtgttcctttgcgccttgagcccactggggcagttgctccaggaccgctacggatggcgcggtggattccttattctcggaggtctgcttctcaattgctgcgtgtgtgcagcacttatgcggccactggttgtcaccgcccaacctggatcgggacctccacgaccatcacggcgcctcctggaccttagcgtgttcagggatcgcgggttcgtgctgtacgcggtggccgcctcagtgatggtgctgggcttgttcgtccccccggtctttgtggttagctacgccaaggacctgggtgttccagacaccaaggccgcattcctgctcactatcctggggtttatcgatatctttgcacggcctgccgcggggtttgtggccgggctcggcaaggtgcgcccttacagcgtgtacctgttttcgttctcgatgttcttcaacggacttgccgacctggccggaagcaccgcaggggactacggaggacttgttgtgttctgcatcttctttggcatctcgtatggcatggtgggagcactgcagttcgaggtgctgatggcgatcgtgggcacccacaagttttcgtcagccattggcctggtgttgctgatggaagctgttgccgtgctcgtgggcccgccgagcgggggaaagttgctggatgctactcatgtgtacatgtacgtgttcatcctggccggagcagaagtgctgactagctccctgatcctgctgctcggaaacttcttctgtatccgcaagaaaccgaaggagccccagccggaagtggccgcggcagaggaagagaagttgcataagcctccggcggactcgggcgtggatctgagggaagtggaacacttcttgaaagcggagccggagaagaacggagaagtggtccacaccccggagacttcggtc

SEQ ID NO: 33770 - DNA, 1395 bp, Artificial Sequence
  Description of Artificial Sequence: Synthetic coding sequence
atgggcggtgctgtggtggatgaaggccccactggtgtgaaggcccccgatggcggatggggttgggccgtgctgtttgggtgttttgtcatcactggcttttcctacgcattcccaaaagctgtttcagttttctttaaagaactcatccaagagtttggcattggatactcagatacagcctggatttcctccattctactcgcaatgctgtacggaaccggtcctttgtgcagtgtctgtgtgaatcgatttggctgcagacccgtgatgctggtgggaggattatttgcctccctgggcatggtcgcagcctcattctgcaggtctatcattcaggtgtacctgactaccggggtgataaccggcttaggcctggctttgaattttcagccttccctgattatgctcaatcggtatttttccaagagaagacctatggccaatggcctagcagctgccggctctccagtctttctctgtgccctgtctccactgggccagctgctgcaggaccgatacggttggcggggcggtttcctcattttagggggactgctgctgaattgctgtgtgtgcgctgccctcatgaggcccctggtggttacagctcagccagggtccgggccacctaggccttcccgtagattgttagatctctccgtgttccgggatcgcggcttcgtgctgtacgcggtggctgcgagcgtcatggtcctaggactatttgttccacccgtgttcgtagtgtcgtacgctaaagacctaggagtccctgacacaaaggccgcattcctactgacaatcctgggattcattgatatcttcgcacgacccgcagccggcttcgttgcagggttaggaaaggtgcggccatactccgtgtacctgttctcattctctatgttctttaatgggctggctgatttggcaggctctacagctggcgattatgggggccttgtggttttttgcatcttcttcggaatatcttacggaatggtgggcgccctgcaatttgaagtgctcatggctatcgttggcacacacaagttctccagcgccattggcctggtcctcctgatggaagcagtcgctgtcctggtcggacccccttctggcggtaaactgctggacgcaactcacgtttatatgtatgtgttcatcttggcgggtgccgaggttttgaccagctccctgatcttgctcctcggaaactttttctgcattcggaagaagccaaaagaaccccaacctgaggtggccgctgcagaagaggagaagttgcataaaccgcctgccgatagtggggtcgatctgcgggaggtggaacactttcttaaggctgagccagagaagaacggagaggtggtgcacacccccgaaactagcgtg

SEQ ID NO: 33771 - DNA, 1395 bp, Artificial Sequence
  Description of Artificial Sequence: Synthetic coding sequence
atggggggagcagtcgtggatgaaggcccgaccggcgtcaaggccccggacggcgggtggggatgggccgtcttgttcgggtgttttgtgattaccggtttttcgtacgcattcccgaaggccgtatcagttttcttcaaggagctgatccaggagtttggaatcggatactccgacaccgcttggatttcgagcatcctgctcgccatgctgtacggtaccggaccgctgtgctccgtgtgcgtgaaccgcttcgggtgccgccccgtcatgctggtgggcggcctgttcgcctccctgggcatggttgctgctagcttctgtcggagcatcatccaggtgtatttgactactggagtcatcactggactcggcttggcccttaatttccagccaagcctcataatgctgaacagatacttctccaagagaaggccgatggcaaatggattggcagccgccggctcacccgtgttcctgtgcgctctttcgcctctcgggcaactccttcaggaccgctacggatggcgcggaggattcctgatcctgggtggactcctcctcaactgctgtgtgtgcgccgcgctgatgaggccgctggtggtgaccgctcaaccaggatccggacctccacggcctagcagacgcctgttggacctgagcgtgtttcgggatagaggttttgtgctttacgcggtcgcggcatcagtgatggtgctggggctgtttgtgccgcctgtgtttgtggtcagctacgccaaggatctcggcgtgccggatactaaggctgcgttcttgctgaccatcctgggatttatcgacatcttcgctcggccagcggcaggctttgtggccggactgggtaaagtgcggccgtattcggtgtacctcttctccttctccatgttcttcaacgggctcgcggacctcgctggttctactgccggcgattacggtggactggtcgtgttctgcatcttcttcggaatctcgtacggcatggtgggggcactgcagttcgaggtgcttatggcgattgtgggaacgcataagttttcatccgccatcggactcgtgctgctcatggaagccgtcgcggtcctggttggaccaccttcgggaggcaagctcctcgacgcaacccacgtctacatgtacgttttcattctggccggagccgaagtccttacctcgtcactcatcctgctgctgggaaacttcttctgcatccgcaaaaaacccaaagaaccacaaccggaagtggcagcggcggaggaagagaagctgcacaagccgcctgcggatagtggagtggacctgcgagaggtcgaacatttcctgaaagccgagccagaaaagaatggagaagtcgtgcacacgcccgagacttcggtg

SEQ ID NO: 33772 - DNA, 1395 bp, Artificial Sequence
  Description of Artificial Sequence: Synthetic coding sequence
atgggaggagctgtcgttgatgaagggcctactggagtgaaagcccccgatgggggatgggggtgggccgtactattcggatgcttcgtcattacagggttctcttacgcttttcccaaagctgtgagtgtgttctttaaagaactaatccaggaattcggaattgggtattctgacacagcatggatatcatccattcttctggcgatgctctacggaactgggcctctatgctccgtgtgcgtcaaccggttcgggtgcaggcccgtaatgttagttggaggattatttgcttcacttgggatggtagcagctagtttctgtcgctctatcatacaggtttatctgactacaggggtcattacagggcttggactcgctctcaatttccagcccagtctcatcatgctcaataggtatttctctaaaagacggcctatggctaatggactagccgcagccggatcacccgttttcctctgtgccttgtcacccctcggacagttactgcaggatcggtatgggtggagaggaggattcctcatcttaggagggctgctcttaaactgctgcgtgtgtgccgcactcatgagaccactggtagttactgcccagcccgggtcaggaccccctcgcccttcccggcggttgctggatctctcagtttttcgagatagaggattcgtcctctacgctgtggccgcctccgttatggttctgggacttttcgtgcctcccgtgtttgtggtctcttatgctaaagacctcggagtgcccgatactaaggccgctttcctcctcactatcttgggattcatcgatattttcgcccggcccgctgcgggatttgtggctgggctcggaaaagtgcgaccttattcagtatatctgttttcattttccatgttttttaatgggctcgcagatcttgccggatctacagcaggagactatggagggttggtcgtattctgtatcttttttgggatatcctacggaatggttggggctcttcagtttgaagtgctgatggcaattgtaggaactcataagttttcctcagccattggacttgtattattaatggaggccgttgctgtcttagtgggacccccttcaggaggaaaacttctcgatgcgactcatgtctatatgtatgtctttatacttgccggagctgaagtgttgacatcatctctcatcctgctcctcgggaattttttctgtattaggaagaaacctaaagaaccacagcccgaagtggccgctgctgaggaagagaaattacataaaccccccgctgactctggagtggatttaagggaagtcgaacattttctcaaagctgaacctgaaaaaaatggagaagtggtccatactcctgaaacatctgtc

SEQ ID NO: 33773 - DNA, 1395 bp, Artificial Sequence
  Description of Artificial Sequence: Synthetic coding sequence
atgggcggcgcagttgtggacgagggacccaccggagtgaaagcccccgacggaggttggggttgggctgtcctgttcggctgttttgtcatcacaggcttcagctacgcttttcccaaggccgtctccgttttctttaaggaactgatacaagagtttggaatcggatactctgacacagcctggatcagctccatcctcctggccatgttgtacggaactggccctctgtgcagcgtgtgtgttaatcgctttggatgtaggccagtcatgttggttggaggattgtttgcatcactcggtatggtcgccgcttccttttgccgttccatcatccaggtttacctcactactggagtgattaccggtctgggtttggccctgaatttccagccctccctgatcatgcttaatcgctacttcagcaagaggagaccaatggctaacggtttggctgccgctggttcccccgtctttctctgtgcactttctcctttgggccaactgctccaggatcgctacggctggagaggcggttttctcattctgggaggtctcttgttgaactgttgcgtgtgtgcagccttgatgcgtcctctggtggtgaccgctcagcccggaagcggaccaccacgccccagccgtcgcttgcttgatttgagtgtttttcgcgaccgcggcttcgtgctctacgcagtggcagcttctgttatggtgttgggcctgttcgttccccctgtattcgttgtttcttacgccaaggatttgggagtccccgacacaaaagccgccttcctgctgacaatcttgggtttcatagatatttttgcacgcccagcagccggctttgtggccggcctcggtaaggtgaggccctatagcgtttaccttttctctttcagcatgttttttaatggcctcgccgatctggccggttccaccgcaggtgattatggaggtctggtcgtgttctgtatcttttttggcatctcctatggcatggtaggtgcattgcagttcgaagttctgatggcaatcgttggtactcacaagttctcctctgctatcggtctggtccttctgatggaggccgtcgccgtgctggtcggcccaccctccggtggcaagctgttggacgccacacatgtgtatatgtacgtcttcatcctggctggagccgaggtgctcacttcttcattgatactgcttctgggcaacttcttctgtataaggaaaaagccaaaagagccccaacctgaagtggctgccgctgaggaagagaagcttcataagccccctgccgactccggcgttgacttgcgcgaggtagagcacttcctgaaagcagagccagagaagaacggagaggtcgtacacacacctgaaacctctgtg

SEQ ID NO: 33774 - DNA, 1395 bp, Artificial Sequence
  Description of Artificial Sequence: Synthetic coding sequence
atgggtggcgctgttgtcgacgagggcccaaccggagtgaaggcgcctgatggtggatggggttgggctgtgcttttcggttgcttcgtgatcactggattcagctacgccttcccaaaagctgtgtctgtgttttttaaagaacttattcaagagtttggaatcggctacagcgatactgcatggatatcttcaatcttgctggcaatgctttacggaacaggtcctctttgcagtgtttgcgtcaataggtttggctgcagaccggtaatgctggtaggcggcctcttcgcttctttgggaatggtcgctgcaagtttctgtagatcaatcatacaggtgtatctgaccactggagtgatcaccggcctcggcctggctctgaattttcagccttctctcataatgctgaataggtatttctcaaagaggagacctatggcaaatggactggctgccgctggatcaccagtgttcctctgtgctctcagtccgctcggacagcttttgcaggacaggtacggctggaggggtggtttccttatcctcggaggtctcctgctgaactgttgcgtctgtgctgccttgatgaggcctttggtagtcaccgcccagccaggctcaggacctccacgcccaagtaggcgccttctggacctcagtgtgtttagagatagaggcttcgtgctctacgccgtcgctgcctctgtgatggtcttgggactgttcgttccccctgttttcgtggtttcttacgcgaaggatctcggagtacccgatacaaaagccgccttcctcctcacaatcctcggctttattgacatctttgccaggcccgccgcaggattcgttgctggactcggcaaggttagaccgtactccgtataccttttttcattttcaatgttctttaacggactcgctgacctggccggttctaccgctggtgactacggtggtctcgtggtgttctgcatctttttcggaatctcttatggcatggtaggtgccctccagtttgaagttttgatggcgatcgttggtacacacaagttttcttcagcaatcggcctggtgctcctcatggaagctgtcgctgtcttggttggacccccgtccggaggaaagttgctcgatgccactcacgtgtacatgtatgtattcattttggctggtgctgaggtcctgacatcctctcttatcctccttcttggcaacttcttctgcatcaggaaaaagccgaaagagccacaaccagaagtagctgcagccgaggaggaaaaactgcataaacctcccgctgattctggcgtggatctgcgcgaagttgagcactttttgaaggctgagcctgaaaagaacggcgaagtggttcatactccagagacatcagtg

SEQ ID NO: 33775 - DNA, 1395 bp, Artificial Sequence; identical to SEQ ID NO: 33747
  Description of Artificial Sequence: Synthetic coding sequence

SEQ ID NO: 33776 - DNA, 1395 bp, Artificial Sequence
  Description of Artificial Sequence: Synthetic coding sequence
atgggcggagctgttgtcgatgaaggacctactggggtcaaagcgcctgacggtggatggggatgggcagtgctgtttggctgctttgtgattacgggtttctcctacgcgtttccaaaggccgtctcggtattctttaaggaacttattcaggagtttggaattggatactcagacactgcatggatttcctccatactgcttgctatgctttacggaactggccctctgtgttccgtgtgtgtgaatagatttggctgtcgtcctgtcatgctggtcggtggactgtttgccagcctgggcatggtggccgcctcattttgtcgttcgattattcaagtgtacctcaccactggggtgattactggactcggactggcccttaactttcaaccatcactcatcatgctgaatagatacttttcgaagagacggccaatggcaaacggtctggctgcagcgggctcccctgtattcctttgtgccctgtcgcccctgggacaacttcttcaagataggtacggttggcgcggtggttttctgatcctgggaggccttttgctgaactgttgcgtgtgtgcagcactgatgcgaccgcttgtggtgaccgcacagcctgggtccggacctccacgcccctcaagacgtctccttgatctgagcgtgttccgcgacagaggttttgtgctgtacgccgtggcggcctcggtcatggttttgggactgttcgtgcctccagtgtttgtggtgtcatacgcaaaggatcttggcgtgcctgataccaaagcagcttttcttcttaccattctggggtttatagacatatttgcacgaccagccgcagggtttgttgcgggtcttggaaaggtgcgcccatactccgtgtacctgttttcgtttagcatgttctttaacggcctggcagacctcgcaggatccactgccggagactatggtggtttggtggtgttttgtatcttttttggtatttcctacggcatggtgggcgcactgcagttcgaagtcctgatggccattgtcggaactcacaaattctcctcggcaattgggcttgtgcttcttatggaggctgtcgctgtgcttgtgggtcctccctccggaggaaaattgcttgatgcgacccatgtctacatgtacgtgtttattctggcaggagccgaagtgctgacctcctccctcattctcctccttggaaacttcttctgcatcagaaagaagccgaaggaaccgcagcctgaagtggcggcagccgaagaagagaagctgcataaacccccagcggattcaggagtggacctcagagaagttgaacatttcctgaaggcagaaccggaaaagaacggggaagtggtgcataccccagaaacctcagtt

SEQ ID NO: 33777 - DNA, 1395 bp, Artificial Sequence
  Description of Artificial Sequence: Synthetic coding sequence
atgggaggggccgtggtggatgagggacctaccggtgtgaaagcgcctgatggtggttggggttgggcggttctgttcggctgtttcgtgattaccgggtttagctacgcctttcccaaggcagtgagcgtattctttaaggagctgatccaagagttcggaatcggctactctgacactgcgtggatatcctcgatcctgctggcaatgctgtacgggactggccctctgtgttccgtgtgcgtgaaccgcttcggctgtcggccagtcatgttggtcggaggccttttcgcatccctgggaatggtcgccgcttcattttgtagatccattattcaggtctacctgacgactggagtcattacgggattggggctggcacttaactttcaaccttccctgatcatgcttaacagatacttttccaaaaggcgcccaatggcaaacgggttggccgcggctgggtcgcctgtgttcctttgtgccctttccccgctgggccaacttcttcaagataggtacggatggcgcggaggtttccttatccttggaggactgctgcttaattgttgtgtgtgcgcagccctcatgcgtccgctcgtggtcactgcacagcctggatcgggtccaccaagaccgagccgacgtctgcttgatctttcagtctttagggatcgcgggtttgtgctctatgcagtcgcggccagcgtgatggtgctcgggctgttcgtgccccctgtgttcgtggtgtcatacgcgaaggacttgggagtccccgatacgaaggctgctttcctgctcaccattctcgggtttatagacatttttgctcggccggcagcagggttcgtggccgggctgggaaaggtccgtccctactccgtgtaccttttctcgtttagcatgtttttcaatgggcttgcagatctggcaggctccacggcaggggattacggcgggcttgtggtgttttgtattttctttggaatcagctacggtatggtgggagcactccaatttgaagtgttgatggcaatcgtcggtacccataagttttcttccgctattgggctggtgctgctcatggaagccgtggccgtgcttgtgggtcctccatccggcggaaaacttctcgatgcaactcacgtctacatgtatgtgtttattctggcgggagcagaagtgcttactagctcgctcatcttgctcttggggaatttcttttgcatccgtaagaaacctaaagaacctcagcctgaggtcgcagcagcagaggaggaaaaacttcacaaaccccctgcagactcaggagtcgaccttagagaagtcgagcattttctgaaagccgaaccagaaaagaacggagaagtcgtgcatactcctgagacttcagtc

SEQ ID NO: 33778 - DNA, 1395 bp, Artificial Sequence
  Description of Artificial Sequence: Synthetic coding sequence
atgggaggcgccgtagtcgatgaaggcccaaccggcgtaaaggctcccgatggggggtggggctgggccgtcctgttcggatgcttcgtgattactggctttagctacgctttcccaaaggccgtgtctgtgttctttaaagagctaatacaggagttcgggatcgggtatagcgacaccgcttggatttcctctattttgctcgccatgctgtatggaactggccctctatgttccgtctgcgtaaatagatttggatgtagacctgtgatgctggtgggtggtctgtttgcatcactgggaatggtagctgccagtttctgtcgcagtatcattcaggtgtacctgacaactggggtgattacaggactggggctggccctgaacttccagccgtcactgatcatgctgaatcgctacttctcaaagaggcggccaatggctaatggcctggccgcggcagggagcccagtttttctatgcgcgttgagccctctaggacagctactgcaggaccgatacggttggcgcggggggttcctgattctaggcggcttactgctgaactgttgcgtgtgcgcggcactcatgagacccctcgtcgtgacggcccagcccgggtctggccccccacgtcctagtaggcgccttctcgacctgagcgtctttagggacagggggtttgtgttatacgcggtggcagctagtgtaatggtgctgggcttgttcgttccccccgtttttgtggtgtcatacgctaaggacctgggcgttcccgatacaaaagcagcctttctgctgacaattcttggtttcattgacatattcgccaggccggcagccgggtttgtggctgggctggggaaggtgagaccatacagcgtctatctcttcagtttttccatgtttttcaacggattggctgatctggcaggttccaccgcaggcgattacggaggccttgtggtgttttgtatcttcttcgggatttcctatggaatggtgggcgccctgcagtttgaagttctaatggccatagtcgggacacataagttctcttcggcgatcggtttggtgctgcttatggaagctgtggccgtgctcgtagggcccccttcggggggaaaacttttagacgccacacacgtatacatgtatgtttttatcttggctggggccgaggtgctcaccagctccctgattctcctcctgggaaatttcttttgcataagaaagaaacctaaggagccccagccagaagtggccgcagccgaggaggaaaagctacataagccacccgctgatagcggggtcgacctgcgcgaagtggaacacttcctaaaggctgagcccgaaaagaatggagaagtggtacatacccctgagaccagcgtg

SEQ ID NO: 33779 - DNA, 1395 bp, Artificial Sequence
  Description of Artificial Sequence: Synthetic coding sequence
atggggggagcagtcgtggacgaaggacctacaggcgtcaaagctcccgacgggggatgggggtgggcggtccttttcggctgttttgtaataaccggcttttcctacgcttttcctaaagccgttagtgtattttttaaagaactgatccaggaatttgggatcggctactccgatactgcctggataagcagcatccttctggccatgttatatggcacaggacccttatgcagcgtgtgtgtgaatagatttggatgccgccctgttatgctggtggggggcttgtttgcaagcctggggatggtggcagcctccttctgtcgtagcatcattcaagtgtacctcacgaccggagtgataaccggactcggactggcacttaactttcagcctagtctgattatgctgaatcgctacttttctaagagacgaccgatggccaatgggctggcagccgcgggctctcctgtgttcttgtgcgcactgtccccactgggtcagctgctccaggatcgctacgggtggcggggcgggttccttattcttgggggcttgcttctgaactgctgtgtctgtgctgccctcatgagacctctggtggttaccgcccagccaggctccggccccccccgtccatcccggcgcctgctagatctgtctgtgttcagggaccggggctttgtgctgtacgctgtggccgctagcgtgatggttttgggacttttcgtgccgcctgtttttgtagtgtcttatgcaaaggacctgggtgtgcctgacacgaaggcagctttcctactgacaatcttaggcttcatagacatttttgcccgtcctgcagccgggttcgtagccgggcttggtaaggtccggccctatagcgtgtacttgttttctttctcaatgttttttaatggcctggcggacctcgcaggctctaccgccggtgattatgggggcttggtcgttttttgtattttctttggcatcagttatggcatggtgggcgctctgcagttcgaagttttgatggcgattgtgggaacacacaagttttcctctgccataggactggtgctcctgatggaagccgtggctgtactagtggggccaccatctggcgggaagctgttggatgctacacatgtctatatgtacgtatttatccttgccggggccgaagtgctcacatcatccttgatcctccttctgggtaatttcttctgtatcagaaagaagcccaaagagccccaacccgaagtggccgccgccgaagaggaaaagctacataagcccccagctgactccggagtggatttgcgagaggtagagcacttcctgaaagccgagcctgaaaaaaatggtgaggtggttcacacacccgagacatccgtc

SEQ ID NO: 33780 - DNA, 1395 bp, Artificial Sequence
  Description of Artificial Sequence: Synthetic coding sequence
atggggggcgctgttgtggatgagggaccgacaggagtgaaagcacccgatggcggatggggctgggccgtacttttcggctgcttcgtgattaccggattttcttatgccttccccaaggctgtcagcgtgttttttaaggagctcatacaagagttcggaatcggctattccgacacagcgtggatatcatcaatactgttagctatgttgtacggcactggacccctgtgttccgtatgtgttaaccgatttggctgccgacctgtgatgttggttgggggcctgttcgcctctctcggaatggtggctgcgagtttttgcaggtccatcatacaggtctatctaaccaccggcgtcataactggtctgggcttggctttgaactttcagcccagcctgatcatgctgaataggtactttagcaagcgtcgccctatggccaacgggctggctgcagcaggatctccggtattcctgtgtgcgctttcaccactcggccaattgctccaggaccgctatggatggcggggcggatttctcatcctgggcggattgctcctcaactgctgcgtctgtgccgcgctgatgcgcccattggtggtgaccgctcaacctgggtctgggccacccaggcccagtaggaggctccttgatctttctgtgtttagagacagaggatttgtgctatatgcagtagccgcctctgtcatggtcctgggactctttgttccccctgtgttcgtagttagctacgccaaagatctcggagtccccgataccaaagccgccttcctcctgactatattgggatttattgacatcttcgctcggcccgctgccggctttgtcgctggactcggaaaagtaaggccctatagtgtctacctattttctttctctatgttttttaatggtctggcagatctggctggaagtaccgcaggggactacggcggcctagttgttttttgtatcttttttggcataagttacgggatggttggtgctttgcaattcgaagtgttaatggccatagtgggcacacacaagttttctagtgctatagggttagtgctgctcatggaagcagtagcggtgctcgtagggccccctagtggtggaaagcttctggacgctacacatgtgtatatgtacgtctttatcctggccggcgcagaggttctgacgtcctcactgatactcctcctcgggaattttttttgtattcgcaagaagccaaaggaaccccaacctgaagtggcagccgccgaggaagaaaagctccataagcctcccgcggattccggggtggacttgcgagaagtggaacacttcctgaaggccgagcccgagaagaatggagaggtggtccatacacctgaaaccagcgtc

SEQ ID NO: 33781 - DNA, 1395 bp, Artificial Sequence
  Description of Artificial Sequence: Synthetic coding sequence
atggggggcgcggtcgttgacgaaggacctaccggagtgaaggcccctgatggcggctggggctgggctgtgctgtttggatgctttgtgatcaccggattttcttatgcctttcctaaagctgtgagcgtctttttcaaagagttaatacaggaatttggaatcgggtacagtgacaccgcatggatttcatcaatcttgcttgccatgctttacggcacaggacccttgtgctcagtctgcgtgaacaggttcggctgtcggccagtgatgttggtaggcgggttattcgcaagccttgggatggtggcggctagcttttgcaggagcatcatccaggtgtatctgacaaccggagtaatcactggcctgggactcgctttaaacttccagccgtctctcatcatgctcaaccgctatttctctaaaagaaggcctatggctaacggcctggcagctgcaggatcgcccgtgttcctttgtgcacttagccctttaggccagttgctgcaggacagatacggctggaggggtggctttctgatcctgggaggactgctgctgaactgttgtgtgtgcgctgcgctcatgaggcctctggtggtcacggcacagccaggctcaggaccacccaggcccagcaggaggttgttggacctgtctgtgtttagagacagggggttcgtgttatacgcagtggctgcctctgtcatggtgcttggcctcttcgtacccccagtgttcgtggtttcgtatgcaaaagatctgggagtcccagacaccaaggccgccttcctgttgacaatcctcggattcatagacatcttcgcgagacccgcagctggatttgtcgcaggcctgggcaaggtccggccatactctgtgtacttgttcagcttttctatgttctttaacggattagctgacctggcgggcagcaccgctggcgattacggcggactggtcgtcttttgcatatttttcggcatttcatacggcatggtgggagctctacaattcgaggtcctgatggccattgttggcacacacaaattctcgtcggctatcggtcttgtgctgctgatggaagccgtcgccgtgctggtgggtccacccagcggtggaaagctcctggacgccacccatgtttacatgtacgttttcatcctggcaggcgcggaggtgctgaccagtagcctcatcttgctcctcggtaactttttctgtatccggaaaaagccaaaagagccccaaccggaggttgccgcggcagaggaagaaaagcttcacaaaccacccgctgactcaggcgttgacctgagagaggtcgagcattttctgaaagcggaacctgaaaagaacggcgaggtggtgcatacacctgaaacaagtgtg

SEQ ID NO: 33782 - DNA, 1395 bp, Artificial Sequence
  Description of Artificial Sequence: Synthetic coding sequence
atgggcggcgctgtcgttgatgagggtccgacgggcgtgaaggcaccggatggcggctggggctgggcggtgctgttcggttgttttgtcattaccggttttagctatgcctttccaaaggcggtatccgtctttttcaaagagttgattcaggaatttggtatcggttacagcgataccgcatggatctcctccattctgctagcgatgctctatggtactggtccgctgtgttcagtgtgcgtgaatcgctttggctgccgacctgtgatgctggtgggtggcctgttcgccagcctggggatggttgctgcctccttctgccgcagcattattcaggtttacctgactacgggtgtgattacagggctgggtctggcactcaacttccagcctagcttgatcatgctgaatcgatatttctctaaacgtcgcccaatggccaacggattagctgccgctgggtcacctgtcttcctgtgtgcactgagcccgctggggcagctgctgcaggaccgctacggatggcgcgggggtttcttaatcctgggaggcctgctgttaaactgctgtgtttgcgctgcactgatgcgcccgctcgtcgtaaccgcccaaccaggatcgggcccgccgcgcccgtcccgccgactcctggatctaagcgtgtttagggaccgcgggttcgtactttatgccgtggcggcctcagtgatggtgctggggttgtttgtcccaccggtgtttgtggtgtcctatgcgaaagatctgggggtgcctgataccaaggccgcatttctgctaaccatcctgggattcattgatatttttgcccgccccgcggctggctttgtggccgggctcggtaaagtgcgcccttactctgtttacttgttctccttttccatgttctttaacggcctggcggatttggctggtagcaccgcgggggactacggcggcttggtcgttttttgcattttcttcggtattagttacggtatggtgggagccctgcagttcgaggtgttaatggcgattgtcggcactcacaagtttagcagcgctattggtctggtgttactcatggaggcagtcgccgtgttggtcggcccgccatctggtggcaagttgctcgacgccacccatgtttacatgtacgttttcatcttagctggtgccgaggttctgacttctagcctgatactactcctcggtaactttttttgcattaggaagaagccgaaggaaccacaaccagaagtagcagcagcggaagaagagaagctgcacaagcctccagcggactctggcgtcgacctgcgcgaggttgagcattttctgaaggcggagccggagaagaacggggaagttgtgcacaccccagagaccagcgtg

SEQ ID NO: 33783 - DNA, 1395 bp, Artificial Sequence
  Description of Artificial Sequence: Synthetic coding sequence
atgggaggtgcagtggtcgatgaaggaccaacaggagtaaaagcaccagatggaggctggggttgggccgtgttgttcggatgcttcgtgatcacaggattctcatatgcattcccaaaggcagtctctgtctttttcaaggaactgattcaggagttcggaatcggatactccgatacagcttggattagttcaatactgctagcgatgttatatggaaccggaccattgtgtagcgtgtgtgttaaccgcttcggatgtcgcccggtaatgctggtcggtggactgttcgcctcattgggaatggtcgcagcttctttttgtagatcaattattcaagtgtacttgactacaggggttatcactggactaggactcgctcttaacttccaaccgtcattgattatgctcaatagatatttcagcaaacgtagaccaatggcaaatggtttggcagcagctgggagtccagttttcttgtgtgctttatctccactgggacaacttttacaagatcgatatggatggcgtggaggattcttgattttgggcggactcctcttgaattgttgcgtttgcgctgctctcatgcgacccctcgtcgtgaccgcacaacctggtagcggtccaccaagaccatcccgtaggctcttggatctgtccgtctttagggaccggggatttgttttgtatgcggttgctgcttcagtcatggttctgggactctttgtcccaccagttttcgtagtaagttatgctaaagatttgggggtccctgatacaaaggcagcttttctgctcacgatccttggattcattgacatcttcgcaagaccagcagcgggatttgttgcaggtctgggcaaggtacgaccatactctgtgtatcttttttctttctcaatgttttttaacggactcgcagatttggctggatcaacggcaggagattatggaggattggtggttttttgcatttttttcggtatttcatacgggatggtaggcgcactacaatttgaagttctcatggctatagtaggaacacacaagttttctagtgctatcggcctagtgctattgatggaagctgttgcagttttggtggggccgccatccggtggaaagttgcttgacgcaacgcatgtgtacatgtatgtatttattctggcaggagcggaggtgctcacctcgtcccttatactacttctgggaaattttttctgtattcgtaagaaaccaaaggaaccgcaaccagaagtcgcggctgccgaggaggagaaactgcataaaccgcctgcagatagtggggtggatttgcgggaagtcgaacactttctcaaagctgaacctgagaaaaatggagaagttgttcatacacctgagacttccgtg

SEQ ID NO: 33784 - DNA, 1395 bp, Artificial Sequence
  Description of Artificial Sequence: Synthetic coding sequence
atggggggcgctgtggtcgatgagggacccactggtgtaaaagcacctgacggaggctggggatgggctgtactttttggctgttttgtcataacaggtttcagctacgcatttcccaaggccgtgtcagttttcttcaaggagctcatccaggaattcgggattggttatagtgacacagcctggatcagtagtattttgttggccatgctctacggaaccggtcctctgtgctcagtctgcgtcaacaggttcggatgtcgcccagtgatgctggttgggggactctttgcatctttgggaatggtggcggcctccttttgccggtctatcatccaggtgtaccttaccaccggagtaatcacaggccttggcttggcgttgaactttcagccaagtctgattatgcttaacaggtacttttccaaaaggcgcccaatggccaacggactcgccgccgctgggagccctgttttcctgtgcgcactctcccctctgggccagctgctgcaggatcggtacggctggaggggcggatttctgatcctggggggactcctgctgaactgttgcgtatgcgccgcacttatgcggcctctggtcgtgaccgctcagccaggttccggcccgccaaggcctagcagaagactgctggacctgtccgtgttcagggaccggggattcgtgttgtacgctgtggccgctagcgtgatggtgcttgggctgttcgtgcctccggtcttcgtcgttagttacgctaaggacctcggcgtgcctgatacaaaagccgcgttccttctgactattctcggctttattgatatctttgcccgacccgccgcgggttttgtggctgggctggggaaggtgcgaccctattccgtctacctttttagcttctccatgttctttaacgggcttgctgatctggctggatccacagctggggattatggcgggctggtcgtgttttgtattttcttcgggatttcttacggcatggtcggtgctctgcagttcgaagtgctgatggccattgtggggacccacaagtttagtagcgctatcggcctcgtgctgctgatggaggcggtcgccgtgttggttggccccccgtcaggaggcaagcttctcgacgcgacacatgtgtatatgtacgtgttcatcctggcgggagctgaggtgctgactagctcactgatcctcctgcttggaaactttttctgcatacggaaaaagcccaaggagcctcagcccgaggtggcggctgccgaagaggaaaagttgcataagccccctgccgattccggggtggatctgcgcgaagtggaacacttcctgaaagcagagcccgaaaagaatggcgaggtagtgcatacgccagaaacaagcgtc

SEQ ID NO: 33785 - DNA, 1395 bp, Artificial Sequence
  Description of Artificial Sequence: Synthetic coding sequence
atgggcggagccgtggtcgacgaaggcccaaccggagtgaaggccccggacgggggctggggatgggcagtgctgttcgggtgttttgtcataactggtttctcatacgctttcccgaaagcagtgtccgtattcttcaaagaactcatccaggagttcggaatcggatactcggacacggcctggatctcgtcgatccttctggctatgctctacggcaccgggccgctgtgcagtgtttgcgtgaacagatttggatgccgcccggtgatgctcgtgggaggcctttttgcgtcgctgggcatggtcgcggcttcgttttgccgttcaatcatccaagtctacctcactaccggggtgattactggactgggacttgccctgaattttcagccgagcctgatcatgctgaaccgctacttcagcaaacggcgtccaatggcgaatggcctcgcagccgccggctccccggtgttcctttgcgccctctcacctctgggacaactgctgcaggatagatacggctggagaggaggattcttgatccttggcggtctgctccttaattgttgtgtatgcgcggctctgatgcggccacttgtcgtgactgctcagcctgggagcggtcctccgcgcccgagtcgccggctgctcgacctgtccgtgtttagggatcggggattcgtgctttatgccgttgcggcatcggtgatggtgctggggctctttgtgcctccagtgttcgtagtgtcgtacgcgaaggatctgggagtgcccgacaccaaggccgcctttctgctgaccattcttggattcatcgacatctttgcacggccagcggcaggattcgtggctggactgggcaaagtccgcccctactcagtctatctcttctctttctcgatgttcttcaacggactggcagatctggctggatcgaccgccggagactacggcggcctcgtggtgttctgcattttcttcggtatctcctacggaatggtgggtgccctccagttcgaggtgcttatggctatcgtcgggactcacaagttctcttccgccatcggactggttctcttgatggaagcggtcgctgtcttggttggaccaccaagcgggggaaagctgctcgatgcaacccacgtgtacatgtacgtgtttatcttggccggagccgaggtcctcacgtcctcactgatcttgctgcttggcaactttttctgcattcgcaagaagccgaaggagcctcaaccggaagtggctgcggccgaggaggagaaactgcataagccgcctgcggacagcggagtggatctgagggaagtggagcatttcctgaaggccgaaccagaaaagaacggtgaagtcgtccacaccccagaaacttccgtg

SEQ ID NO: 33786 - DNA, 1395 bp, Artificial Sequence
  Description of Artificial Sequence: Synthetic coding sequence
atggggggagcggtggtcgatgaaggcccgaccggtgtcaaggcccccgacggcggttggggttgggcagtcctttttgggtgttttgtgatcactggtttctcgtatgcgttcccgaaggccgtgtccgtgttctttaaggagcttattcaagaatttggcattggttactccgatactgcatggatttccagcattctgctggctatgttgtacggtactggacctctttgctcagtgtgcgtgaataggtttggatgtaggccagtcatgctcgtcgggggactgtttgcgtccctgggaatggtggcagcctctttttgtaggtcgattatccaggtgtacctgacgaccggtgtgattacgggtcttgggctcgcactcaactttcaaccaagtctcattatgctgaaccgctacttcagcaagaggcggccgatggcaaacggactcgccgcggcaggttccccggtgtttctttgtgcactcagccccttgggccaactcctgcaagatcgctacggatggagaggagggttcctgattctcggtggactcctcctgaactgttgtgtgtgcgcggccctcatgcggccactcgtggtcaccgcccagccgggatccggtcctccgcggccttcacgccgactcctggacctttcggtgtttagagataggggatttgtgctgtacgccgtcgccgcgtcggtcatggtccttggcctttttgtccctccagtgttcgtggtgagctatgcaaaagatttgggtgtgccagatactaaggctgcatttctgctgaccattcttggttttatcgacatttttgcaagacctgcagcggggttcgtggcaggacttggcaaggtgcgtccatactcagtctaccttttcagctttagcatgtttttcaatggattggcagatcttgcaggttcgacggctggtgattacggtggtttggtggttttctgtattttctttggcatcagctacggaatggtgggagccctgcaatttgaagtgctgatggcaatcgtggggacgcacaagttctcctcagcaattgggctcgtgctccttatggaagctgtggcagtgctcgtggggcctccaagcggtggaaaactcctggatgcaactcacgtctacatgtacgtgtttattcttgccggcgctgaggttctcacctcgtccctgatccttctgctgggcaactttttctgcatcagaaagaaacctaaggaaccacagccagaggtcgccgcagcagaggaagaaaaactgcataagccccccgcagacagcggtgtcgatctgagagaagtggagcatttccttaaagctgaaccagagaaaaatggtgaagttgtccacactccagagacttcagtg

SEQ ID NO: 33787 - DNA, 1395 bp, Artificial Sequence
  Description of Artificial Sequence: Synthetic coding sequence
atgggaggcgctgtcgtggacgaaggaccaaccggagttaaggcaccagatggaggttggggctgggcagtcctgtttggatgttttgttattaccggcttctcgtacgcatttcccaaagccgtcagcgtgtttttcaaggagctgattcaagagttcggtatcgggtactccgacactgcttggattagctccatactccttgctatgctctacggaacgggtcccttgtgctcggtctgtgtcaataggtttggctgcagacccgtgatgcttgttggaggacttttcgcttcgcttggaatggtggcagcctcgttttgtagaagcattatacaggtatatctgactaccggagtgatcaccgggttggggctcgcattgaattttcagccgtcactgataatgcttaacagatacttttcgaaacgacgaccgatggcgaacggccttgcagcggcagggtcccctgtgtttctgtgtgctctctcgccactgggtcaactgcttcaagaccggtacgggtggcggggtgggtttctcattctgggcgggcttctgctgaactgttgcgtgtgtgcagctcttatgaggcctctcgtcgtgaccgcccagcctggttcaggacctccacggcctagtcgaagattgcttgatctttccgtattcagggatcgcggcttcgtcctctacgcggtggccgcatcggtcatggtcctcggacttttcgtgcctcccgtctttgtggtaagttatgcaaaagatctcggtgtgccagatactaaggcagcatttctgttgaccatcctcggattcattgatatctttgcacgccctgccgcaggctttgttgcaggactgggaaaggtgcgtccttactctgtgtacctcttctccttttcaatgtttttcaatggacttgccgaccttgcgggatctactgcaggcgattacggcggtctggtggtgttttgcatattctttggaatttcctacgggatggtgggagcgctgcaatttgaggtgttgatggcaattgtcggaactcacaaattctcttccgccattgggctcgtgttgctgatggaggcagttgcagtgcttgtgggtcctccgtcgggcggtaagctgctcgacgcgacccatgtctacatgtacgtgtttatcctggcgggagcggaagtgctgaccagctcccttatcctgcttttgggtaacttcttctgtattcgtaaaaagccgaaagaaccacagccagaagtcgcagccgcagaagaggaaaagctccacaagcccccagcagactccggagtggatcttagagaagtggaacatttcctgaaggcagaacctgaaaagaacggggaagtggtgcatacgcccgagacttccgtg

SEQ ID NO: 33788 - DNA, 1395 bp, Artificial Sequence
  Description of Artificial Sequence: Synthetic coding sequence
atgggaggtgccgtcgtagacgagggacctaccggggtgaaggcccctgacggaggctgggggtgggctgtgctctttggttgcttcgtcattactgggttcagttatgcatttccaaaggccgtgtctgttttcttcaaggagcttatccaggagttcggcatcggatattctgacactgcttggatctctagcatccttctagccatgctatatgggaccgggccgctgtgttcagtctgcgtaaaccgtttcggctgtcggcctgtaatgctagtcggcgggctctttgccagcctgggcatggtagcagcctccttctgtcggtccatcatccaggtatacctgacgaccggggtgatcaccggtctaggcctggccttgaatttccagcctagtctaattatgcttaatcggtacttctcaaagcggcgacccatggcaaacggcctggccgcagctggatcgccagtattcctctgtgccctcagtcccctcggccaactacttcaagacagatacggctggagaggtggattcctgattctgggtgggcttcttctgaattgctgtgtgtgcgcagccttgatgcgacctctggtcgtgacggctcaacccggcagcggcccgcctaggccaagccgcagactgctggacctcagcgtctttagagacaggggctttgtgctgtacgcagtggcggcatctgtaatggtactggggttatttgtgcctcctgtcttcgtggtcagctacgccaaggatctgggcgttcccgataccaaggcggcgtttctcctcacgatccttggcttcatcgatatcttcgcacgacctgccgctggttttgttgcaggattaggaaaggttagaccatatagcgtgtacttattctcttttagcatgttcttcaatggcctggcggatcttgcagggagtactgctggagattacggaggcttggtggtgttttgtattttctttgggattagttacggcatggtcggggccctgcaattcgaggtcctgatggccattgttggaacccataaattttcttcggccattgggttggtactgctgatggaagccgtcgcggtccttgtcgggccaccctccggagggaagttgctggatgctacccacgtgtacatgtacgtgttcatcctggctggagcggaagtgcttacatcaagcctgatcctgttactcggcaacttcttctgtatccgaaaaaagcctaaggagccacagcccgaagtggctgccgccgaggaggagaaactgcataagcctcctgcagatagcggggtagacctgcgagaggtggagcatttcctgaaggcggaacccgaaaagaacggcgaggtggtgcacacaccggaaacatccgtg

SEQ ID NO: 33789 - DNA, 1395 bp, Artificial Sequence
  Description of Artificial Sequence: Synthetic coding sequence
atgggaggggccgtggtggacgagggacctaccggcgtgaaagcccctgatgggggctggggctgggcagtcttgttcgggtgctttgtgataacggggtttagttatgcctttccaaaggctgtttccgtgttctttaaagagctcattcaagagtttgggatcggatattccgatacggcttggattagctctatcctgctggccatgctctacggaaccggacccctttgctctgtgtgcgtcaatcgcttcggttgtagacccgtgatgcttgtgggtggtctgttcgcctcactgggaatggtggccgcatccttttgtaggagtatcatccaggtgtacctcacaacaggagtgattactgggctcggcctggccctgaatttccagccatccctgatcatgctgaacagatatttcagcaagagacggcccatggccaacggcctggctgcagctggcagtccggtctttctctgtgccctgtctcccctgggccaattgctgcaggatcgatacggatggaggggcggcttcttgattctgggcggtctcctcctgaactgctgtgtctgcgctgccttgatgagaccattggtggtgacagcccaacccggctctggacctccacgcccctctagaaggctcctggatctttctgtgttcagggatcgaggcttcgtgctgtacgccgttgcggctagcgtcatggtcctcggcctgttcgtgccaccggtgtttgtcgtgagttacgctaaggacctgggtgtgccggacactaaagccgccttccttctcaccatactgggctttatcgatattttcgcccggccggccgccggtttcgtggctgggctgggcaaggttaggccttatagcgtgtatttgttctccttcagtatgtttttcaacgggctggccgacctggccggatcaacagcaggggattatggtggtctcgtggtgttctgcatcttctttggcatttcttacggtatggttggggcccttcaattcgaagtgctcatggctatcgtggggacccacaagttctcctctgcaatcggccttgtgctcctcatggaggccgtggctgtgctcgttggcccaccctccggcggtaaactccttgatgccacacacgtctatatgtatgtgtttattctggccggagccgaagtgttgaccagctccctgatcctgttgctggggaacttcttctgtatcagaaagaagccaaaagagcctcagcccgaagtcgcggcagctgaagaggaaaagctgcacaagccacctgcagactcaggcgtcgacttgcgcgaggttgagcatttcctgaaggctgaacccgaaaaaaatggggaggttgtccacacgcccgagacgagtgtt

SEQ ID NO: 33790 - DNA, 1395 bp, Artificial Sequence
  Description of Artificial Sequence: Synthetic coding sequence
atgggcggcgctgtggttgacgaagggcccacaggcgtcaaagccccggatggaggttggggttgggccgtgctgttcggatgctttgtaattacgggattctcgtacgctttccccaaagctgtgtccgtatttttcaaagagcttattcaggagttcggcattggttatagcgataccgcttggattagcagtatactcctggccatgctgtatggcacaggcccgctatgcagtgtctgtgtgaaccgcttcggttgcaggccagtcatgttggtgggtggactgttcgcctccttaggcatggtagccgccagcttctgccgcagcataattcaggtgtacctgactacaggcgtaataaccggattgggactggcgctgaacttccagccctccctgatcatgctgaaccgctactttagcaagcgacgccccatggccaatggtctggcagcagctggctcccccgtctttttatgcgccctgtcaccgttaggccagctgcttcaagatcgatatggatggcggggcggttttctgattctgggaggtttgctgctgaactgttgcgtatgcgctgccttgatgcgcccccttgtagtgaccgcacagcctggcagtgggccgccgcgcccctcccgccgactgctggacctcagcgtgttccgtgaccgtggatttgtactgtacgcggtggcggcgtccgttatggtgttaggcttgttcgtccccccggtgtttgtagtcagctacgccaaggacttgggcgtgccggataccaaggcagccttcctgctgaccattttaggattcatcgatatttttgcacgcccagcagctggatttgtggccggcttgggtaaggtccgaccatatagcgtgtaccttttttcattctcgatgttttttaacggcctggcggatctggctggctctactgcaggcgactacggtggtctggtggttttttgtattttcttcggtataagttacggtatggtgggagccctgcagttcgaagtgcttatggccatagtggggactcataagttcagctcggcaatcggtctcgtgctgctgatggaagcagtcgctgtgctcgtcggcccgccctcgggaggtaagttgttagacgccacccacgtttatatgtacgtgttcatcctcgctggtgccgaggtgttgacgagtagccttattctgttgctcggcaatttcttctgcattcgcaagaagcccaaggagccacaacctgaggtcgctgccgccgaggaggagaagttgcacaaaccacccgctgactccggcgtggacctccgggaggtggagcacttcctgaaggccgagcctgaaaagaatggcgaagtcgtccacaccccggagacgtcggta

SEQ ID NO: 33791 - DNA, 1395 bp, Artificial Sequence
  Description of Artificial Sequence: Synthetic coding sequence
atgggcggcgccgtggtcgatgaaggaccgactggagttaaggccccagacggcgggtggggctgggccgttctcttcgggtgctttgtgatcacgggtttttcctacgcatttcccaaagcagtgtccgtgttctttaaagagcttatccaagaattcggcatcggctattccgacactgcatggatctcttcaatcctgctggctatgctgtatggcactggcccactctgttctgtgtgtgtaaaccgattcggctgccgccccgtgatgctggttggcggtctcttcgcaagtttggggatggtggccgcatctttttgtcgctctatcatccaggtgtacctgacaacgggggtaatcactggcctgggccttgccttgaacttccagccaagtctgataatgctgaatagatacttctctaagcggcgcccaatggctaatggactggcggccgcggggagccccgtgttcctgtgcgccctctccccactgggtcagctgcttcaggaccgatatggttggcggggggggtttttgattctgggaggattgttgctcaattgctgtgtgtgcgccgcactcatgagaccgctggtggtgaccgcccagccgggctctggtccaccacggccatctcggcggctgctcgatctgtccgtctttcgagatagaggcttcgtcctttatgctgtggcagcttcagtgatggtcttggggttgtttgtccccccagtgttcgtcgtgagttacgccaaggatctgggagtgcctgacactaaggcagccttcctgttgacaattctgggctttatcgacatcttcgccagacctgctgctggcttcgtggccggtctcggaaaggtgagaccttatagcgtgtatctcttttccttttccatgtttttcaatggcttggctgatttggctggcagcacagctggtgactacggaggtttggtggtcttctgtatattttttggcatcagctatgggatggtgggcgcgctgcaattcgaggtcctcatggccatcgtcggcacacacaagttcagctctgccattggtctcgtcctgctgatggaggctgtggcggtgttggtggggcctccttctggagggaagttgctggatgcaacgcatgtctacatgtacgtgttcattctcgctggggctgaggtgctgacctcatctctgatcttgctcctgggtaactttttctgtatccgcaaaaagcccaaagaacctcaacctgaagtggccgccgccgaggaagaaaagctgcacaagccaccggctgattccggtgtggatctgcgagaagtcgaacacttcctcaaggccgagcccgagaaaaatggggaggtggtccacacgcctgaaacgagcgtg

SEQ ID NO: 33792 - DNA, 1395 bp, Artificial Sequence
  Description of Artificial Sequence: Synthetic coding sequence
atgggcggcgcggtggtggacgaaggacctacaggagtcaaagcccctgatgggggctggggctgggcggttcttttcgggtgtttcgtgataacaggcttttcctatgcatttcctaaagcagtatccgtgtttttcaaagaactgattcaagaattcggcattgggtattcagatacggcatggatatctagcattctgctggccatgctgtatggaaccggcccactctgctccgtgtgcgttaacaggttcggatgcagaccggtgatgctcgttggcggattatttgcttcacttggtatggttgcagcctcattttgtaggtctatcattcaggtctatctgaccacaggcgtaatcactgggcttgggctggcattgaactttcaaccctctttgattatgctgaaccgctatttctccaagcggagaccgatggctaacggtttagcagccgctgggtccccagtgtttttgtgcgcccttagtcccctaggacagctgctgcaagaccggtacggctggaggggaggtttcctgatcctcggcggcttgctcctgaactgttgcgtatgcgccgcactgatgcgcccgctcgtggtgacagcacagcccggttcaggccctccaaggccgtctcgccgcctcctggatctttccgtttttagagataggggcttcgtactctacgctgtggctgcaagtgtgatggtgctgggcctgtttgtacccccagtgtttgtcgtttcttatgctaaagatctcggagttcctgatacaaaggccgcgtttctattaaccatactgggcttcatagacatttttgcacgtcccgccgccgggtttgtagcaggattgggtaaggtgcggccctattccgtgtaccttttttcgtttagcatgtttttcaatgggctggctgacctggccggctccactgccggagattatggaggattggtagttttctgtatcttcttcggcatctcatacggcatggtaggcgccctccagttcgaagtactcatggctatcgtcggtactcataaattttcttctgcaattggcttggtgctcctgatggaggccgtggctgtgctcgtgggcccaccttctggcgggaagctccttgacgcaacccatgtctatatgtatgtcttcatcctggcaggcgccgaggtgctgacatccagtctcattctgctactcgggaattttttctgtattcggaaaaagccgaaggagccgcagcccgaagttgctgccgcggaggaagaaaagcttcacaagccgcccgcggacagcggggttgacctgcgggaggtggaacactttcttaaagctgagcctgagaagaatggagaggtcgtccacaccccggaaacatcagtg

SEQ ID NO: 33793 - DNA, 1395 bp, Artificial Sequence
  Description of Artificial Sequence: Synthetic coding sequence
atgggcggcgccgtggtcgacgaaggccccacaggggtcaaagcccccgatggcggctggggctgggcggttctgtttgggtgtttcgtgataacaggattttcatatgccttccctaaggccgtctcagtgttttttaaggagcttatccaggagttcggaatcggatactccgacaccgcctggattagctctatcctcctggccatgctttatggcacgggacccctatgctccgtgtgcgtgaaccgcttcggatgtaggcccgtaatgttggtcgggggcctgtttgctagtctggggatggtggccgcgtcattctgtagatctataatccaggtttacctcacaaccggggtcattacaggcctggggcttgccctcaacttccagccaagcttgatcatgctgaacaggtactttagcaagcgccggcccatggccaatggacttgcggcggctggctctcccgtcttcttgtgcgccctctcccctttgggtcagctgctgcaggacagatatggctggagaggcggattccttatcttgggaggactgctcttgaactgctgtgtgtgcgccgctctgatgaggcctttggtcgtcaccgcacagcccggttcaggaccccctagaccctccaggcgccttttggacctctctgtttttcgggatcggggctttgtgctgtacgccgtggccgccagtgtcatggtgctggggctgtttgtgcctcccgtgtttgtcgtgtcttatgccaaggaccttggtgtgcccgacacaaaagccgcatttctgcttactatactggggttcatcgacatcttcgccagaccagccgctggcttcgtggccggacttggcaaagtgcgtccttacagtgtgtacctattttccttcagtatgttttttaatggcctcgcagacctggcgggaagcaccgctggtgattacggagggctcgtcgtcttttgcattttttttggcatttcttatggaatggtgggagctttgcagtttgaagtactgatggccatagtgggaactcacaagttcagctctgcaatcggcctggtcctgctcatggaggctgttgcggtgctggtggggcccccttctggcgggaagttgctggatgctacccacgtgtacatgtatgtgtttatcctagccggggccgaggtgctcacttcatccctcattctgctgttggggaattttttctgcatccggaagaagcccaaggagccgcagcccgaggtggcagcagccgaagaggagaagctgcacaagcctcctgcggattctggcgtggaccttcgggaggtggaacacttcttaaaagctgaacccgagaagaacggcgaggtcgtccacactcctgagacaagcgta

SEQ ID NO: 33794 - DNA, 1395 bp, Artificial Sequence
  Description of Artificial Sequence: Synthetic coding sequence
atgggcggcgcggtggttgatgagggccccacaggagtcaaggcacctgacggagggtggggctgggccgtcctgttcgggtgtttcgtcataaccggcttcagttacgcattcccaaaggcagtcagtgtgttcttcaaggagctgattcaggagttcggaatcggctattccgacaccgcctggattagtagcatcctgctagccatgctctacggtacgggccccctgtgctcagtgtgcgtcaacaggttcggttgcagaccggtgatgctggtgggggggctattcgccagtctggggatggttgccgccagcttttgccggtcgatcatacaggtttacctaactaccggcgttatcaccgggttgggattggcgctcaactttcagccatccctgatcatgctcaacaggtacttcagtaaacggcgtccaatggcaaatgggctggccgctgccggaagcccagtttttctgtgcgcactatcgccattgggtcaactattgcaggacagatatggatggcgtggcggctttctcatcctgggaggcctcctcctgaattgttgtgtgtgtgccgcactgatgcgccccctggtggtgacagctcaaccgggctccggacccccccgtccttcccggcggctgctcgatctgtctgtattccgggaccgaggtttcgtcctgtatgctgttgccgcctctgtgatggtgcttggcttattcgtcccaccagtgtttgtagtgagttacgctaaggatcttggtgtccctgataccaaagccgctttcctccttaccatcctcggtttcattgacatcttcgctcggcccgctgcaggctttgtggcgggtctgggtaaggtaagaccgtactcggtatacttattcagtttctccatgttttttaatgggctggccgatctcgccggttcgacggcgggagactacggtggcctggttgtcttttgtattttttttggcatatcttacggaatggttggagccttacagtttgaagtgttgatggccatcgtgggcactcacaagtttagctcagcaattggcctggttctacttatggaagcagtggcggttttagtgggacctcctagtggcggaaagcttctcgatgctacacatgtttacatgtatgtgttcatcttagcaggggccgaggttctcacgtcttcattgatcttgttgctgggaaactttttctgcatcaggaaaaaacctaaggagcctcagccggaagtggcggccgccgaggaggaaaagctgcacaagccgcctgccgattctggtgtggacctgcgcgaggtcgagcactttctgaaagcagagccagagaaaaacggtgaagtagtccatacacctgagacctccgtc

SEQ ID NO: 33795 - DNA, 1395 bp, Artificial Sequence
  Description of Artificial Sequence: Synthetic coding sequence
atggggggcgccgtggttgacgagggccctacaggcgtgaaagctcctgacggcgggtggggatgggccgttctgttcggctgtttcgtgattacaggattctcctatgcgtttccgaaagccgttagtgtttttttcaaagaactgattcaggaatttggtatcggatatagtgatacggcctggatctcgtctatacttcttgccatgctctatgggactggtcctttgtgtagtgtctgtgttaacaggtttggatgtcgcccagtaatgcttgtggggggactgttcgcaagtctgggcatggtggcggcctcgttttgtaggtctatcatccaggtttatctgactaccggagtaatcaccggtctaggcctggcgctgaatttccaaccctcactgatcatgcttaatcggtatttttccaagagaaggccgatggccaatggcctggcagccgctgggagccccgtgtttctctgtgcactgtctcccctggggcagctgctgcaggaccgctatggctggcggggagggttccttatactgggcggcctactcctgaattgctgcgtttgcgccgccctgatgaggccattggtggtcaccgcccagccaggaagcgggcctcctcgcccatcccgacgactcctcgacctgtctgtctttagagacagaggtttcgtactgtacgccgtggccgcctctgtcatggtcctggggctcttcgttccacccgtgttcgtcgtgtcctacgctaaagacctcggagttccagacacaaaagcagccttcctcctgaccatactggggtttatcgacatttttgctcgtcctgcggccggtttcgtggccgggctgggcaaggtaaggccgtactctgtgtatttattctctttctcaatgttttttaacggtcttgccgacctggcagggtctacagctggagattatgggggtttggtggtgttttgtatcttcttcggcataagctatggaatggtcggggctctccaattcgaggtgctcatggcaattgtgggcacccacaaattctcctcggcaattggtctggtgctcctaatggaggctgtagccgttctggttggaccaccctcgggcggcaagctgcttgacgctacacatgtgtacatgtacgtttttatcttggccggtgccgaggtgctaacctctagtctgatcctgcttctgggcaatttcttctgcatcagaaagaaacctaaagaaccgcaacctgaggttgcagcagccgaggaggagaaactgcacaagccacccgcagatagcggcgtggacctgcgagaagtggagcactttctaaaagcagaacccgagaaaaatggcgaagtggtccatacaccagagaccagcgtc

SEQ ID NO: 33796 - DNA, 1491 bp, Artificial Sequence
  Description of Artificial Sequence: Synthetic coding sequence
atgacttttaattcatttgaaggatcaaaaacatgcgtgcccgccgatattaacaaggaggaagagttcgtggaggagtttaaccgattgaagacatttgcgaatttcccttccgggagtccggtgtcagcttctacgctggcacgggcaggttttctttacacaggggagggcgacaccgtgcgatgtttttcctgccacgcggcagtagatagatggcagtatggcgattccgcggttggcagacaccgcaaagtatcccccaactgcagattcattaacggtttctatctcgagaacagcgctactcagtccactaattcagggatccaaaacgggcagtacaaggttgagaattacttgggaagccgagaccatttcgctctggatcgacccagcgagacgcatgccgactatcttttgcgcacgggtcaggttgtcgacattagtgatactatctacccaagaaatcccgcaatgtattctgaggaagctagactgaaatcctttcagaactggcccgactatgcacatttgacaccccgggaattggcttctgctggactctactatactggcattggggatcaggtgcaatgcttttgctgcggcggtaaactgaagaactgggagccctgtgaccgggcgtggagtgagcaccggcgccactttccgaattgctttttcgtgcttggccggaacctgaacatccgctctgagtcagatgctgtgtcatcagacagaaacttccccaatagtactaatctccctagaaatcctagcatggcagactatgaagctaggatattcaccttcggcacatggatctatagcgtgaacaaggaacagctggcccgagccggattctatgccctgggcgaaggcgacaaggtcaaatgcttccactgtgggggtggcctgaccgactggaaaccctcagaagacccatgggagcaacatgccaagtggtatcccggatgcaagtatctcttggagcagaagggacaagagtacatcaacaatatccaccttacgcactcactcgaagagtgtctggtgagaactacagagaagactcccagtcttaccagacgcatcgacgacaccatatttcagaatcctatggtacaggaggccatcaggatgggcttttccttcaaggatatcaagaagatcatggaggaaaaaatacaaattagcggatcaaactataagtcccttgaagtcttggtcgctgacctggtcaacgcccagaaagactctatgcaggacgagtcttctcagacctccctgcagaaagagatttccacagaggagcagctccgaaggcttcaggaggagaaactgtgtaaaatttgcatggacagaaacatcgccatcgtctttgttccatgtgggcatctggtgacttgtaagcaatgcgcagaggccgtggacaagtgccctatgtgctacacagttattacatttaagcagaagatatttatgagc

SEQ ID NO: 33797 - DNA, 1491 bp, Artificial Sequence
  Description of Artificial Sequence: Synthetic coding sequence
atgaccttcaatagcttcgaaggttccaagacctgcgtgccagcggacatcaacaaggaagaggaatttgtggaggaattcaataggctgaaaactttcgccaacttcccgtcgggctctcctgtgagcgcaagcaccttggccagagccggattcctgtacaccggagaaggggacactgtgcggtgcttctcatgccatgcggccgtcgatcggtggcagtacggagattccgccgtcgggcgccatcggaaggtcagtccgaactgccggttcatcaatggattctacctggaaaattccgccacccagagcactaactcgggaatccagaacggacagtacaaggtggagaactacctcggatccagggaccacttcgccctggaccgcccgtcagagactcacgccgattacctgcttaggactggacaagtcgttgacatatcagatacgatctacccgcgcaaccccgccatgtacagcgaagaagcgcggctcaaaagttttcagaactggcctgactacgcgcacctgaccccgagagagctggcctccgccgggctgtactacactggaatcggcgaccaggtccagtgcttctgctgtggaggcaagttgaagaactgggagccgtgtgacagagcttggtcggagcataggcggcacttcccgaattgctttttcgtgctgggtcggaatctcaatatccggtcggagtcggatgcagtctcgtcggacagaaactttccaaactcaaccaatctcccgcggaacccatccatggccgattacgaggcccgcatcttcaccttcggcacctggatctactcagtgaataaagaacagcttgcccgtgccggattctacgcgctgggcgagggagacaaggtgaaatgcttccactgcggtggaggcctcacggactggaagccgtccgaagatccttgggagcaacacgcgaagtggtaccctggttgcaagtacctcctcgaacaaaaaggacaggagtacatcaataacatccacctcacccatagcctggaagaatgcctggtccgcacgaccgaaaagaccccgtcgttgaccagacgcattgatgacaccatctttcagaacccgatggtccaagaagccatccgtatgggattctcgtttaaggatatcaagaaaatcatggaggagaaaatccagatctctggatccaactacaaatccctcgaggtgctcgttgcggatttggtgaacgcacaaaaggactctatgcaggatgagtcgagccagacctcacttcagaaagagatctcaaccgaggagcaactccgccggctgcaggaggaaaaactgtgcaagatctgcatggacaggaacatcgccattgtgtttgtgccctgtggacacctggtgacctgtaagcaatgcgctgaggctgtggataagtgtcctatgtgctacactgtgataaccttcaagcaaaagatcttcatgtcg

SEQ ID NO: 33798 - DNA, 1491 bp, Artificial Sequence
  Description of Artificial Sequence: Synthetic coding sequence
atgactttcaactcctttgagggaagcaaaacctgtgtgccggctgatatcaataaagaggaggaatttgtggaggaattcaaccggctcaaaacttttgcgaacttccccagcggatccccagtgtcagcttccacccttgcccgcgccggattcctctacacgggcgagggcgataccgtgcgctgcttctcttgccatgctgccgtggaccggtggcagtatggagacagcgctgtgggcagacacaggaaggtgtcgccgaactgcagattcatcaatggattctacctcgaaaatagcgctactcaatcaaccaactccggcattcagaacggacagtacaaggttgaaaactaccttggttcccgggaccacttcgccttggacagaccgtcagaaacccatgctgactatcttctcagaactggacaagtggtggacatttccgacaccatttacccccgcaatccggccatgtactcggaagaagctcgcctcaagtcgttccagaattggcccgattacgcacatctgaccccgcgcgagctcgcctcggcagggctctactacaccggaattggcgaccaagtgcagtgtttctgctgcggaggtaagctgaagaactgggaaccctgcgacagagcatggagcgaacaccggcgacacttcccgaactgtttcttcgtcctcgggcgcaacctgaatatccgctccgagtctgacgcggtgtcctccgatcgcaacttccctaactcgaccaacctgccccggaatccgtccatggcggactacgaggcgcgcattttcacttttgggacctggatctactcggtcaacaaagagcagctggctagggccggcttttatgctctgggggagggagacaaagtcaaatgcttccattgcgggggaggactcaccgattggaaaccatctgaagatccatgggaacagcatgccaagtggtacccgggatgtaagtacctcctggagcaaaagggacaggagtacatcaacaatatccacctgacccactcactggaagaatgcctggttcgcaccactgaaaaaactccgtcgcttactcgtcggatcgacgacactatctttcagaacccaatggtgcaggaggctatcaggatgggtttctcgttcaaggacatcaagaagatcatggaagaaaagatccagatctcaggctcaaactacaagtccctcgaagtgctcgtggccgaccttgtgaacgcgcaaaaggactcgatgcaggacgagagctcgcagacgtcattgcaaaaagaaatctcgaccgaggaacagctgcggcgcctgcaggaggaaaaactgtgcaaaatctgcatggacagaaacatcgcaattgttttcgtgccttgcggacacctcgtgacttgcaagcagtgcgcggaagcagtggacaaatgcccgatgtgttacactgtgatcaccttcaagcagaaaatctttatgtca

SEQ ID NO: 33799 - DNA, 1491 bp, Artificial Sequence
  Description of Artificial Sequence: Synthetic coding sequence
atgacatttaactcattcgaaggcagtaaaacatgtgtcccagccgatattaacaaagaggaagagtttgtcgaagagtttaatcgtttaaagacatttgcaaactttcccagcggatccccagtctccgccagcacgctagcccgggctggctttctgtatactggtgagggagataccgtcagatgcttttcatgccacgcagctgtcgacaggtggcagtatggcgattccgcggtggggcgccatagaaaggtctcccccaattgcagattcatcaacggcttttacttagagaacagcgcgactcagtcaaccaactctggcatccagaatgggcagtacaaggtagagaactatctgggcagtagagaccactttgctctcgaccgcccttccgagacacatgccgattatttgctgagaacaggccaagtagtggacatctcagataccatctatcctcgaaatccagctatgtattcagaagaagcaagactcaaatcttttcagaactggccagattacgcccatctgacacctcgtgagctggccagtgcaggcttgtactacactggcatcggggaccaggtgcagtgcttttgttgcggtggtaaacttaagaactgggaaccctgtgaccgggcttggtctgaacatcgtaggcatttccccaactgcttcttcgtgcttgggagaaacctgaatattagatctgaatctgacgcagtgagtagcgaccgaaacttcccaaactcgaccaatctcccacggaaccctagcatggctgattacgaagctcgtatctttacgttcggtacctggatctattccgtcaacaaggagcaactggcacgcgccggcttctatgccctgggggagggcgacaaggtgaagtgctttcattgtggcggcggcttgacggactggaaaccatcagaggatccatgggagcagcacgcgaaatggtatcccggttgcaagtatctgctagagcagaagggccaggaatatattaataatatccatctaacacactccctggaagaatgcctggtgcggacaacagagaaaacaccatcactaaccagacggattgacgatacgatcttccaaaatcccatggtgcaagaggcaatacggatgggattcagctttaaagatattaagaagattatggaagagaagattcagataagtggaagtaattataaaagtctggaggtgctcgtggccgacctggtcaatgcccaaaaagattcgatgcaagatgagtccagccagacatctctgcagaaggagatctcgacagaggaacaacttaggaggctgcaggaagagaagctgtgtaaaatttgcatggatcgtaatattgccatcgtcttcgtcccctgtggtcaccttgtgacatgtaagcaatgtgccgaggctgttgacaagtgtcccatgtgttacacagtcatcacctttaagcagaagatttttatgagt

SEQ ID NO: 33800 - DNA, 1491 bp, Artificial Sequence
  Description of Artificial Sequence: Synthetic coding sequence
atgacctttaactcgtttgaaggttcaaagacgtgtgtccccgcagacataaacaaggaggaagaattcgtcgaagagtttaacaggctcaaaacttttgcaaatttcccttcgggttcacctgtttccgcgtcgacgttggcaagggcaggattcctgtacacgggtgaaggcgacaccgtgaggtgtttctcgtgtcacgccgcggtggaccgctggcagtacggagattcggctgtcggcagacaccggaaggtgtctcctaattgtcggtttatcaatggtttctaccttgagaactccgcaacgcaatcaaccaattccggaatccaaaatggacaatacaaagtcgaaaactaccttggatcgagggaccattttgcactggatcgacccagcgaaacccacgcagactacctgctgcggactggtcaagtggtggacattagcgacactatttaccctcgtaatcccgcaatgtattctgaggaagctcgacttaagagctttcaaaattggcctgattacgcacatctgaccccacgagaactggcctcggcaggtctttactacacgggaatcggagatcaggtgcaatgcttttgttgcggaggtaagctgaagaactgggagccatgcgatagagcctggtccgaacatcgacggcatttcccaaactgttttttcgtgctcggaagaaacctgaacatccgaagcgagtcggatgccgtctcatcagacagaaactttcccaactcaactaatcttccgagaaatccatcgatggcagattacgaggcacggattttcactttcggaacctggatttactccgttaacaaagaacagctggcaagagcaggcttctacgcactcggggagggtgataaggtgaagtgtttccactgtggtggtggcctgaccgattggaagccctcagaagatccgtgggagcagcacgccaaatggtaccctgggtgcaaatatcttcttgagcaaaagggtcaagagtatatcaataacatccatctcacccattcgctcgaagaatgcctcgtccgcactactgagaaaacccccagcttgactagaagaatagatgacacgatctttcagaaccctatggtgcaagaagccattaggatgggctttagctttaaggacataaagaagataatggaggagaaaatacagataagcggttcgaactacaaatcacttgaagtccttgtggcggatcttgtgaacgcacaaaaggactcaatgcaggatgagtcctcacagacctcgttgcagaaggaaatttccaccgaagagcagttgcgcagactccaagaagaaaaactttgtaagatttgcatggacaggaacattgcgattgtttttgtcccttgcggacatctggttacttgtaaacaatgcgctgaagccgtggataagtgtcctatgtgttacaccgtgatcacctttaagcagaagattttcatgtcc

SEQ ID NO: 33801 - DNA, 1491 bp, Artificial Sequence
  Description of Artificial Sequence: Synthetic coding sequence
atgacattcaacagcttcgaaggctcaaagacctgtgtgcctgctgacatcaataaggaagaagagttcgttgaagagttcaatcgtctgaagacttttgctaactttccttccggtagcccagttagcgcaagcaccctggccagagcaggctttctgtacactggagaaggtgacactgtccgctgtttcagttgtcatgctgctgtggacaggtggcaatacggcgattctgcagtgggacgccatcgtaaggtgtctccaaactgtaggtttattaacggattctatcttgagaatagtgcaacccagtcaaccaacagtggcatccagaacggtcagtacaaagttgaaaattatttgggctcccgcgaccactttgcattggacaggccctccgaaacccatgcagattacttgcttcgcactggccaggtggtagacatctccgacacaatctacccccgtaatcctgctatgtactctgaggaagctcgtctgaagagtttccaaaattggcccgactacgctcacctgactcctagggagctcgcatccgctggcctctactacactggcattggcgaccaggtgcaatgcttttgttgcggaggcaagcttaagaactgggagccctgcgatcgtgcttggtcagagcatcgccgccatttccctaattgcttcttcgtgctcggccgtaaccttaatatcaggtcagagtcagatgctgtctcctccgaccgtaacttccccaacagtaccaatctgccccgcaacccttccatggccgattacgaggctagaatcttcactttcggaacttggatctatagcgtgaacaaggagcaactggctagagccggattctacgctctcggtgaaggcgacaaggtgaagtgtttccattgcggtggtggcctgacagattggaaaccatccgaagacccctgggaacagcacgcaaaatggtaccccggctgcaaatatctcctggaacagaagggtcaggagtacatcaacaatatccacttgacacatagccttgaagaatgcctggtgcgtacaaccgaaaaaactccttcccttactaggcgcatcgatgatacaattttccagaacccaatggttcaggaggcaatcagaatgggcttctcttttaaggatattaagaagattatggaggaaaagatacagattagtggctctaactacaagagccttgaggtgcttgttgctgatctcgtcaacgcccaaaaagacagcatgcaggatgaaagctcccagacctcactgcagaaggagattagtactgaagagcagttgcgcaggttgcaggaggagaaactgtgcaaaatctgtatggacaggaatatcgcaatcgtcttcgtaccctgcggtcatcttgtgacctgtaaacagtgcgccgaggctgtggacaagtgcccaatgtgttacactgttatcacctttaaacagaaaatcttcatgtca

SEQ ID NO: 33802 - DNA, 1491 bp, Artificial Sequence
  Description of Artificial Sequence: Synthetic coding sequence
atgacgttcaacagcttcgaggggtcgaagacctgcgtgcctgcggacattaacaaagaagaagaattcgtggaggagtttaacaggctgaagactttcgctaactttccaagcggctcacctgtgagcgcatccaccttagcccgggctggcttcttgtacacgggagaaggagataccgttaggtgctttagctgccatgccgctgtagatcgatggcagtacggcgactccgcggtgggacggcaccggaaagtgagcccaaactgcaggttcataaacggattctacctggaaaatagcgctacccagagtaccaactcaggaatccaaaacggacagtataaagtcgagaactatctgggaagcagggatcactttgccctcgataggcctagcgaaacacacgccgattatcttcttagaacaggccaagtcgtcgacattagtgataccatctacccacgcaatcctgctatgtactctgaagaagctcggctgaaatcatttcaaaactggccagattatgcccatctgacacctcgagagttggcttctgctgggctctattacacagggattggtgaccaggtccagtgtttttgctgcggcggaaagcttaaaaattgggaaccatgcgatcgggcatggagtgagcaccgacgccactttcctaactgtttttttgttctcggtcgtaacctgaacattaggtctgaatctgacgctgtttcaagtgatcgaaacttcccaaattctacaaacctgcccagaaatccatctatggccgattatgaagcacgaatctttacttttggcacttggatctactctgtaaacaaagagcaactggccagggcagggttttacgctctgggcgagggcgacaaagtgaagtgttttcactgtggcggaggacttaccgattggaagcctagcgaggatccttgggagcaacacgcgaagtggtacccaggatgtaaatatctgctcgaacagaaaggccaggagtatatcaacaacatccacttaactcactcactggaggagtgtctcgtgagaaccacagagaagacacctagcctgacgagaagaatcgatgataccatcttccaaaatcccatggtgcaagaggcaataaggatgggattctcatttaaggatatcaagaagatcatggaggagaagatccaaatcagtgggagcaattacaagagccttgaggtattggtcgccgacctggttaacgcccaaaaagactccatgcaagacgaatccagtcaaacatccttgcagaaggaaatcagcaccgaagagcagcttcggcgcctccaagaggagaagctctgtaagatctgcatggataggaatatcgcgattgtcttcgtaccctgtggtcaccttgtcacctgcaagcagtgtgcagaagctgtggataaatgccccatgtgctatacagtgatcacatttaagcaaaagatctttatgagt

SEQ ID NO: 33803 - DNA, 1491 bp, Artificial Sequence
  Description of Artificial Sequence: Synthetic coding sequence
atgacgtttaacagtttcgagggctctaaaacctgcgtccctgccgatatcaacaaggaagaagagttcgtagaggaatttaataggctaaaaactttcgcgaatttccctagcggaagtcctgtttccgccagtacactggctcgcgccggctttctatataccggggaaggagacacagtccggtgttttagctgtcatgccgccgttgatcgatggcagtatggtgacagcgctgtcggccgccataggaaagtcagtcctaactgcaggtttataaacggcttttaccttgaaaacagcgcaacccaatctacaaatagtggaatacagaacggccagtacaaggttgaaaactatctgggaagccgagaccatttcgcactggacaggccatccgagacccatgcagactatttattgaggaccggtcaagtagttgacatcagcgatactatatacccccgtaacccagcaatgtactctgaagaagctcgtctgaagtcgttccagaattggccagactatgcccacctgacacctagagaattggcatcagctggcctttattacaccgggattggagaccaggtacagtgcttttgttgtggaggcaagctgaaaaactgggaaccctgcgatcgggcgtggtccgaacaccgacgacacttcccgaactgtttttttgtgctcgggagaaacctgaacattcggtccgaatcagatgcagtgagctccgaccggaactttcccaacagcacgaacctgcctcgtaacccctccatggccgattatgaggcgcgcatctttacattcggcacgtggatctactcggtcaataaagaacagctagcccgagctggtttctacgcacttggcgagggcgataaagtgaagtgtttccactgtgggggagggctgaccgattggaaaccgtcagaagacccctgggagcagcacgcgaagtggtatcctggatgtaaatatctattggagcaaaagggccaggagtatatcaataatatccatctcacgcattccctagaagaatgtctggtgcggacaaccgagaagactccaagcctaaccagaagaatagatgacaccatctttcaaaatcctatggtgcaggaggcaatccgtatggggttttctttcaaggacattaagaaaatcatggaggagaaaattcagatatcgggaagtaattataagtctctggaggtactagtggccgacctggtgaatgcgcagaaggattccatgcaggatgagtctagccagacatcactccagaaggaaatctcaaccgaggaacagctaagacggctccaggaggaaaagctgtgcaaaatttgtatggatcggaacattgctatcgtctttgtgccatgcggtcatcttgtcacatgtaagcaatgtgctgaggccgttgataagtgtcccatgtgctatacggtcattaccttcaagcagaaaatcttcatgtcg

SEQ ID NO: 33804 - DNA, 1491 bp, Artificial Sequence
  Description of Artificial Sequence: Synthetic coding sequence
atgacgttcaactccttcgaaggtagcaaaacgtgcgtgcccgctgatatcaacaaggaggaggagtttgtcgaggagtttaaccggcttaaaacattcgcgaactttcccagcgggagcccggtaagcgcatccaccctcgctagggcaggatttctgtatacaggcgagggggacacagtcaggtgtttcagctgtcacgccgcggtggataggtggcagtacggcgactccgcagtcgggcgccacagaaaggtttctccaaactgccgctttatcaacgggttctacctggagaatagcgcgacacagtccactaatagtgggattcagaacggtcagtataaagtcgaaaattatctcgggtcacgcgatcactttgctcttgataggccgtccgaaacccacgccgactaccttctaaggaccggccaggtcgtggacataagtgataccatatatccccgcaaccctgccatgtatagcgaagaggctagactgaaatctttccagaattggccggactacgctcacctcactcctcgcgagcttgcctcagccggcctctactacaccggcatcggcgatcaggtgcagtgtttctgttgtgggggaaagctgaagaattgggaaccatgcgatcgcgcctggagtgagcatcgcagacacttccccaattgcttctttgtcttgggcaggaatctgaatatcagatcggaatcagatgcggtgagttctgataggaacttccccaattctacgaacctgcctcggaatcctagcatggctgattatgaagccagaatctttaccttcgggacatggatctactccgtcaacaaggaacagctggctagagccggtttttatgccctcggggagggagacaaagttaagtgcttccactgcgggggaggcctcacagactggaagccctcggaagacccatgggagcagcatgctaagtggtatcctggatgtaagtacctgctggaacagaagggacaggagtatattaacaacatacatttgactcattccctcgaggagtgtctagtcagaacaactgagaaaactcccagcctgaccagaaggatcgatgatactatttttcagaacccaatggtccaagaggcaatccgaatgggctttagtttcaaggatatcaagaagatcatggaagagaagattcagattagcgggtcaaactacaagtctctggaggtgctcgtggcggacctggtgaacgcccaaaaagatagcatgcaggatgagagtagtcagactagcctgcagaaggagatcagtactgaggaacaactgcgccgcctgcaggaggaaaaactgtgcaagatatgtatggacagaaacatcgctatcgttttcgtaccatgtggacacctcgtgacctgcaaacagtgtgccgaggcagtcgataagtgtcccatgtgttataccgtgatcactttcaagcagaaaatcttcatgagt

SEQ ID NO: 33805 - DNA, 1491 bp, Artificial Sequence
  Description of Artificial Sequence: Synthetic coding sequence
atgaccttcaacagcttcgaggggtccaagacatgcgtcccggctgatataaataaagaagaggagttcgttgaggaatttaaccgactaaaaacttttgccaatttcccttctggatccccagtttcggcgtctaccttagcccgggccggttttctttatactggtgaaggtgatacggtccgttgcttcagctgtcatgctgctgttgaccgatggcaatatggggactcagccgtcggtcgacatagaaaggtatccccgaattgtaggttcattaacgggttttatttggagaactcagcgactcaatccactaactctggcatacaaaatggccagtataaggtcgagaactaccttgggagccgcgaccacttcgctctggacaggcccagcgagactcacgctgattacttgctacgaacaggccaggtcgtggacatttctgatactatctatcctcggaatccggcgatgtactcggaggaggcacgcctaaaaagtttccagaattggccagattatgcccatttaacccctcgggaattggccagtgcaggcctctattacacaggcatcggggaccaggtacagtgcttctgctgcggaggaaagcttaaaaactgggagccgtgcgacagggcttggagtgagcataggagacacttcccgaactgcttcttcgtcttgggcaggaatctcaatattcgtagtgagtcagatgccgtgtcttccgatagaaattttcccaattccaccaacctccccagaaatccgtctatggctgattatgaggctcggattttcaccttcggaacgtggatctacagcgtgaacaaggaacaattagcccgtgccgggttttacgccctcggagagggagataaagtgaagtgtttccattgcggcggtggtcttaccgattggaaaccatccgaagacccttgggagcagcacgctaaatggtaccctgggtgcaagtatctcctcgagcaaaaggggcaggagtatatcaacaatatacatcttacccattccctcgaggagtgtctggtccgtaccactgaaaagactccttccctgacgagaaggatcgacgataccatctttcagaatcccatggtgcaggaagcgatccgtatgggattttccttcaaggatatcaagaaaattatggaggaaaagatccagattagtgggtctaattacaagtccctagaagtgttagtggccgacctcgtcaatgctcagaaggactctatgcaagacgagtcctcccaaaccagtcttcaaaaagagatctccactgaggagcagttgcgacgtttgcaggaagagaagctctgcaagatttgcatggaccggaacatagctatcgtcttcgtgccatgcgggcatctggtgacttgtaaacagtgtgctgaggcagtcgataagtgtcccatgtgctataccgtcatcactttcaaacagaaaatctttatgtct

SEQ ID NO: 33806 - DNA, 1491 bp, Artificial Sequence
  Description of Artificial Sequence: Synthetic coding sequence
atgaccttcaattcatttgaaggctctaagacctgcgtgccagctgatatcaataaggaggaagaattcgtggaagagttcaaccggcttaagactttcgccaatttccctagcgggtcgccagtttcggcctcgaccttggcaagagccgggttcctgtacacgggggagggcgatactgtcagatgtttttcctgccacgcggcagtggatcgttggcaatacggcgacagcgcagtgggacgccataggaaggtgtcgcctaactgtagatttatcaatggattttacttggaaaattcggcgactcaatcgacgaattcgggaatccaaaacggtcagtacaaagtggaaaactatcttggttcacgggatcattttgctctggatcggccctccgaaacccatgccgattacctgctgcgcactgggcaggtggtggatattagcgatactatttacccgaggaatcctgcaatgtacagcgaggaggcacggcttaaatcgtttcaaaactggcctgactacgcacatctgactccaagagaactggcctcggccggtttgtactacactgggattggtgaccaggtgcaatgtttttgttgcggtggcaagctcaagaattgggaaccatgcgacagagcatggtcagagcatcgccgtcatttcccaaattgcttttttgtgctgggacgaaacctgaacattcggtcggaatcggacgcagtgtcctccgatcgcaatttcccaaatagcaccaacctgccaaggaatccttcgatggcagattacgaagcgaggatattcacttttggaacctggatttactcagtcaataaggagcaactggcgcgggcaggattctacgcactcggtgaaggcgacaaggtcaagtgcttccactgtggaggaggattgaccgactggaagccaagcgaagatccttgggaacagcatgcaaagtggtaccctggatgtaagtacctgcttgagcagaagggccaggaatacatcaataacattcatctgactcacagccttgaggagtgtctcgtgcgcaccaccgagaaaactccttcacttactcgccggattgatgacactattttccaaaaccccatggtgcaagaggcaatcagaatgggcttttcgttcaaggatatcaagaagattatggaagagaagattcaaatttcgggttcgaactacaagtcactggaagtcctggtggcggatctcgtgaatgcccaaaaggattcaatgcaagacgaatcatcacaaacgtcgctccaaaaggaaatctccaccgaggagcagcttcgtcgccttcaggaagagaagctctgtaagatttgtatggatagaaacattgcaattgtgtttgtgccatgtggacaccttgtgacctgcaaacaatgtgcagaggcagtggataagtgcccgatgtgctacaccgtgattacttttaagcaaaagatattcatgtcc

SEQ ID NO: 33807 - DNA, 1491 bp, Artificial Sequence
  Description of Artificial Sequence: Synthetic coding sequence
atgacgtttaactctttcgaaggatccaagacctgtgtgcctgcagacatcaataaagaagaagaatttgtggaggagttcaaccggctcaagacttttgcaaactttccctctggatcccctgtctcagcatcgacccttgcccgagcgggattcctttacactggagagggagataccgtcaggtgcttctcatgtcatgccgccgttgacagatggcaatacggtgacagcgccgtgggacgccaccgcaaagtctcacccaattgccgatttatcaacggattttacctggaaaattcagcgacccagtccacgaattccggaatccagaatggccaatacaaggtggaaaactatctgggctcaagggaccactttgcgctggatcgcccatcggaaacccacgcagattacctgcttcggaccggtcaggtggtcgatatcagcgatactatctaccctcgaaaccctgctatgtattcagaagaagcccgtcttaagagcttccaaaactggccagattacgcgcatctgactccccgtgagcttgcatcagcaggcctgtactacactggcattggtgaccaggtgcaatgcttctgttgtggaggcaaactgaagaattgggaaccttgtgaccgcgcatggtcagaacacaggaggcattttcctaattgtttctttgtgcttggtcgtaacctcaacatcaggtccgaatccgatgccgtgtcatcagataggaactttccgaacagcacgaacctcccgcgtaacccatctatggccgattatgaggcacggatattcacctttggaacgtggatttacagcgtgaacaaggagcaactggcacgcgcaggtttttacgcactcggagaaggagataaggtcaagtgtttccactgcggaggcggtctgactgattggaaaccctccgaagatccatgggagcagcatgcaaagtggtaccctgggtgcaaatacctgcttgagcagaagggacaagagtacataaacaatattcatctcactcatagtcttgaagagtgtctggtccgcaccaccgaaaaaactccatcccttactaggaggatagatgacaccatattccaaaacccgatggtgcaagaagcaatccgcatgggcttttccttcaaggatatcaagaagattatggaagaaaagattcaaatttcagggtcgaactacaaatccttggaagttcttgtggctgatttggtgaacgctcaaaaagactcgatgcaggatgagtcgtcccagacttcactccaaaaggagatttcgaccgaggagcaacttcggaggctgcaggaagaaaagctgtgcaagatatgcatggaccgcaacatcgctattgtttttgtaccatgtggtcatcttgtgacttgtaagcagtgtgcggaggcagtggacaagtgcccaatgtgttacaccgtgatcacttttaagcaaaagatctttatgtcc

SEQ ID NO: 33808 - DNA, 1491 bp, Artificial Sequence
  Description of Artificial Sequence: Synthetic coding sequence
atgacctttaacagtttcgaaggttccaagacttgtgtgccagcagatatcaacaaagaagaggagtttgtggaagagtttaatcgactgaaaacttttgcgaacttcccatccgggagccctgtgtcggcatccaccctcgcaagagcggggtttctctacactggagagggagataccgtgagatgcttctcatgccatgccgctgtggatcgttggcaatatggagattcagctgtgggtcgccataggaaggtgtcgccaaactgtagattcattaatggtttttacctggaaaactcggcaactcagagcaccaactcagggatacaaaacggccagtacaaggtggaaaactatcttggctccagagatcactttgccctggaccggccatcggaaacccatgccgattacctgctccgcaccggacaggtcgtggatatctccgatactatctaccctaggaacccagccatgtactccgaagaagcaagactgaagtcgttccagaactggcctgattacgcacacctgactcctcgtgaactcgcgtccgcaggactttactacaccggcattggtgatcaggtgcaatgtttttgttgtggtgggaagctgaagaactgggaaccttgtgatcgggcatggtcggaacatcgcagacactttcctaattgtttctttgtcctcggccgcaacctgaatattcgttcggaatccgatgccgtgtctagcgaccggaactttcccaacagcactaaccttccccggaaccctagcatggcggattacgaagcccgcattttcacttttgggacctggatttactcagtgaacaaagaacagctggcacgggcgggattctacgcactgggggaaggggataaggtgaagtgttttcactgcgggggcggtctgaccgattggaaaccttccgaggacccttgggaacagcatgcgaagtggtaccctggttgcaagtacctcttggaacaaaaggggcaggaatacatcaacaatattcatcttacccattcgttggaagaatgtctggtgcggaccactgaaaagaccccttcacttacgaggcgaattgacgataccatctttcagaacccaatggtccaagaagcaattagaatggggtttagcttcaaggacattaagaagatcatggaggaaaagatccaaatttccggatcgaactacaaaagccttgaagtgcttgtggcagatcttgtgaacgcccagaaggattccatgcaagatgaatcctcgcaaactagcctccaaaaggaaatctcaaccgaagaacaactgcgccgattgcaagaggaaaaactgtgtaagatatgtatggatagaaacatcgccatcgtctttgtgccttgtggccatctggtcacgtgtaagcagtgtgctgaagcagttgacaaatgcccaatgtgctatactgtgataacgttcaaacaaaagatcttcatgtcc

SEQ ID NO: 33809 - DNA, 1491 bp, Artificial Sequence
  Description of Artificial Sequence: Synthetic coding sequence
atgaccttcaattcgttcgagggctcgaaaacgtgcgtgccggcggacatcaacaaggaggaggaattcgtcgaagagtttaacagactgaaaacgttcgccaacttcccatcgggtagcccggtgtccgcctcgacgctcgcgcgcgctggattcctgtacactggcgagggagacactgtgaggtgtttctcgtgccatgccgcggtcgaccggtggcaatacggcgactcagccgttggacgccacagaaaagtgtcaccaaactgccgcttcataaacggattttacctcgagaactccgccactcagagcactaatagcgggatacagaatgggcagtacaaggtcgaaaactatctcggatcgagagatcattttgcgctggaccgcccgtcggaaacgcacgcagactaccttttgcgcactggccaggtggtcgacatctcggatactatctacccacgcaatccagcgatgtattcagaagaagccaggctgaagtccttccaaaactggccggactatgcccatttgaccccaagagaacttgcttccgccgggctgtactacaccgggatcggcgatcaggtccagtgcttctgctgtggagggaagctgaagaattgggaaccctgtgatagagcatggtcagagcacagacgccattttccgaactgctttttcgtgctcgggcggaacctcaacattcggtcagagagcgacgctgtgagcagcgaccgcaacttcccgaactccaccaatctccctcgcaatccatccatggcagattacgaagcaagaatcttcactttcggcacctggatttactcggttaacaaggagcagcttgctagagccgggttctacgctctgggagaaggcgataaggtgaagtgttttcattgcggcggcggcctcaccgactggaaaccatcagaggacccgtgggaacagcacgcaaagtggtaccctggctgcaaatacctgctggagcagaagggacaggaatacatcaacaatatccacttgacgcactcactcgaggagtgcctggtgaggactactgagaaaactccgtccctcacccgtagaattgacgacaccatctttcagaatccgatggtccaggaagcaataagaatgggtttttcgttcaaggacatcaagaagattatggaggaaaagatccagatttctggatcgaactacaagtccctcgaggtgctcgtggctgacttggtcaacgctcaaaaagattccatgcaggatgaatccagccaaactagccttcagaaggaaatctccaccgaagagcaactgagacgcctgcaagaggaaaagctgtgcaaaatctgcatggatcggaacatcgccatcgtgttcgtcccctgcggacacctggtgacttgtaagcaatgtgccgaagccgtggataagtgcccgatgtgctacaccgtgatcacgtttaaacaaaagatcttcatgtca

SEQ ID NO: 33810 - DNA, 1491 bp, Artificial Sequence
  Description of Artificial Sequence: Synthetic coding sequence
atgacctttaactcttttgagggaagtaagacctgtgtccctgcagatatcaacaaggaagaggagttcgtcgaggagtttaatcggcttaagacctttgccaacttcccttccggatcacccgtgtccgcaagtacgttggctagagcaggattcctgtacacgggagaaggagacactgtgcggtgtttctcatgccatgcagccgtcgatcgatggcaatacggtgattcggcagtggggcgtcatcgcaaagtgtcccccaactgtcgcttcataaacggtttttaccttgagaactcagcaacgcaatcgacgaatagcggcattcaaaacggccagtacaaggtggagaattacttgggttccagagatcatttcgccctggatcgcccttcggaaacccatgccgattacctgctgaggactggacaagtggtcgacattagcgataccatctacccgcggaacccagcgatgtactcggaagaggctcggctgaagtcctttcagaactggcccgactacgcccatctcacccctcgcgagcttgccagcgcgggtctgtactacaccgggattggtgaccaggtacagtgtttctgctgcgggggaaagctcaagaactgggagccttgtgatagagcatggtccgagcataggagacacttcccaaactgcttttttgttttgggccgtaatcttaacattagaagcgaatccgacgcagtgtcatcggatagaaactttccaaattccaccaacctgcctagaaacccaagcatggcagactacgaagcacgaatctttacgtttggcacctggatatactccgtgaataaagaacagcttgcacgggcaggtttttacgcacttggagagggagacaaggtcaagtgtttccattgtggtggaggactgacggattggaagccatcggaagatccatgggaacaacacgcaaaatggtaccccgggtgtaagtacctgcttgaacagaagggacaagaatacattaacaacattcatctgacgcattcgctcgaagaatgccttgtgcgcaccaccgagaaaaccccttcactcactcgtagaattgatgatactatctttcaaaacccgatggtccaggaagctattcgcatgggattctcatttaaggacatcaagaaaatcatggaggaaaagatccagatttccggttcgaattacaaatcactcgaagtgctcgtcgctgatctggtgaacgcccaaaaagactcaatgcaggatgaaagcagtcaaacctcgctgcagaaggaaatttctactgaagaacagctgcgcaggctgcaagaggaaaagctgtgtaagatttgtatggaccgaaacattgcaatcgtgtttgtgccctgtggtcacctggtgacctgtaagcaatgtgcagaagccgtggacaagtgtccaatgtgctacaccgtgatcacctttaagcagaaaatctttatgtcc

SEQ ID NO: 33811 - DNA, 1491 bp, Artificial Sequence
  Description of Artificial Sequence: Synthetic coding sequence
atgacttttaactcttttgaagggtccaagacgtgcgtgccagctgacatcaacaaagaagaggaatttgtggaggagttcaatagactgaaaacttttgctaatttcccttctggctcacccgtgagcgctagcactctggctcgagctggattcttgtacacaggcgagggtgataccgtgcggtgctttagttgccatgccgcggtggatagatggcagtatggagactctgcagttggacgacaccggaaagttagccctaattgtaggtttatcaacggcttttaccttgaaaactcagccactcaatctacaaatagcggaattcagaacggccaatacaaagtggagaattacctaggatctcgggatcattttgctctcgacagaccttccgaaacgcacgcagattatctccttagaacaggtcaggttgtggatatttctgatacaatctatccaaggaaccccgcaatgtatagcgaggaggccagattgaagtcttttcagaactggcccgattacgcgcacttgacgccacgggaactggctagcgctggtctatattacacgggcataggcgaccaggtccagtgtttctgttgtggcggaaaactgaaaaactgggaaccctgtgaccgtgcttggtcagagcatcggagacacttcccgaactgtttttttgtcctgggccggaacctaaacattcgctccgaatctgatgcagtgagtagcgataggaactttcccaattcgactaatcttcccaggaacccatctatggcagactatgaagctcgcatcttcacctttggaacttggatctattcagtgaacaaagaacagctggcaagagccggcttctacgcgctcggagagggcgacaaggtgaaatgttttcactgcggcgggggcctgactgactggaagccctcggaagacccttgggaacaacacgccaaatggtatcccggctgcaaatacctactcgaacaaaaggggcaggagtatattaataacattcatctgactcattccctagaagagtgcttagttcggacgactgagaaaacgccatccctgacgagaaggattgacgatacgatttttcaaaatcccatggtgcaggaggcaatccgcatgggcttctccttcaaggacattaaaaaaatcatggaagagaaaattcagatcagcggcagtaattacaagagtttagaagtactagtggccgatctcgtaaacgcacagaaggatagtatgcaagacgagtcatcccagaccagcttacagaaagagatttctaccgaagaacagctgaggcgcctgcaggaggaaaagctttgcaaaatttgcatggatcggaacatagcaattgtgtttgtgccttgtgggcatctggtcacctgtaagcaatgcgctgaggctgtagataaatgtcctatgtgttatacagtgatcacattcaaacagaaaattttcatgagc

SEQ ID NO: 33812 - DNA, 1491 bp, Artificial Sequence
  Description of Artificial Sequence: Synthetic coding sequence
atgacatttaactcctttgagggctccaaaacatgcgttcctgcagatatcaataaagaggaagaatttgtcgaggaatttaacaggctgaagacctttgccaacttcccttctggaagcccagtctctgcgagtacattggccagagctggctttctgtacacaggagagggagataccgtgcgctgcttctcctgccatgccgccgttgaccgctggcagtacggcgactctgcagtcggtaggcataggaaggtgagtccaaactgcagattcataaatggtttctacctcgagaactctgccactcagagcacaaactcaggtatacaaaatggtcagtacaaagtagaaaactacctgggctcccgcgatcactttgccctggaccgcccgtccgaaacacacgccgactacctgttgagaactggtcaagtggtggatatcagtgatactatctatcctcgcaacccggctatgtattcagaggaagctcgcctgaagtccttccagaattggccagactacgcgcatcttacgccccgcgaactcgcttctgcgggcctctactataccggtattggtgatcaggtgcaatgtttctgttgtggaggcaagctcaaaaactgggagccctgtgatcgcgcatggagtgaacacagacgccacttccctaattgcttttttgtgttgggcagaaaccttaacattcgctctgaaagtgatgctgtgagttctgacaggaactttcctaacagtaccaacctcccacgcaacccctctatggcagactatgaagcgagaatcttcacttttggaacttggatttacagtgtcaacaaggagcaactggccagagctggattctacgcactgggtgagggtgataaggtcaagtgctttcactgcggcggtggactgacggattggaaacccagtgaagatccctgggagcagcatgctaagtggtatcccggctgcaagtacttgctggagcaaaagggccaggagtatatcaataacatacaccttacccattccttggaagagtgcctggtgagaacaacggaaaaaactccctctctgacccgcaggattgacgacacgatcttccagaaccccatggtgcaggaggccatcaggatgggattctcctttaaagacatcaagaagatcatggaggaaaagattcagattagtggttctaactataagtctttggaagtactcgtggcagacttggtgaacgcgcagaaggacagcatgcaagatgagtcatcccaaacgtccctgcagaaggagatttccacagaagagcagctgaggagattgcaagaggaaaagctgtgcaagatttgcatggatagaaacatcgcgatagtgttcgtcccgtgcggccacctggtgacatgtaagcagtgcgctgaggccgtagataagtgcccaatgtgttacactgtgatcacgttcaagcaaaagatatttatgtca

SEQ ID NO: 33813 - DNA, 1491 bp, Artificial Sequence
  Description of Artificial Sequence: Synthetic coding sequence
atgacgttcaactcgtttgagggatcgaaaacttgcgtgcctgcagatatcaacaaggaagaggaatttgtggaggaattcaatcgactcaagactttcgcgaatttcccctcgggctcaccggtgtcagctagtaccctcgcgcgggccgggtttctctacactggagagggtgataccgtgagatgtttttcgtgtcatgcagcagtagatcggtggcagtacggagattcagcagtgggaaggcataggaaggtgtccccaaattgccgttttatcaacggattttacctggagaattcagcaacccagtcgactaattcgggaattcaaaacggacaatacaaggtcgagaactacctcggctcccgggatcattttgcactcgatagaccgtccgaaactcatgcagattacctccttcggaccggccaggttgtagacatcagcgatactatctacccccggaacccagcaatgtacagcgaagaagccagactgaagtcatttcagaattggcctgattatgcacatcttactccaagagagctggcatccgctggcttgtactacaccgggataggtgaccaagtgcagtgcttctgttgcggaggaaaactgaagaattgggaaccttgtgacagggcgtggtctgagcacaggaggcactttccaaactgcttttttgtgcttggcagaaacctcaacatacggagcgagtccgatgctgtctcctcggatagaaactttccaaatagcactaaccttcctagaaatccgtccatggccgattacgaagcacgcattttcacctttggaacttggatctattcggtgaacaaggaacaactggcgcgagcgggattctacgcattgggggaaggtgacaaggtgaagtgctttcattgtggtggtgggctgactgattggaagccatccgaagatccatgggaacagcatgcgaagtggtaccctggctgtaaatacctgctggaacagaaggggcaagagtacattaacaatattcatctcacgcattccctggaagagtgtctggtgagaaccaccgaaaaaacgcccagcctcacccgacgcatagatgataccattttccagaaccctatggtccaagaagccatacgaatgggtttctccttcaaagacatcaagaaaatcatggaggagaagattcaaatctccggttcgaactacaaatcgttggaggtcctcgtggccgacctggtgaacgcccagaaggattcgatgcaagatgaatcatcgcaaaccagcttgcaaaaggaaatttcgaccgaagaacagctccgccgattgcaagaggaaaaactgtgcaagatctgtatggaccggaatattgctatcgtctttgtcccatgtggacatctggtgacgtgtaaacagtgcgccgaagcagtggacaagtgtccaatgtgttacaccgtgattacgtttaaacaaaagattttcatgtcc

SEQ ID NO: 33814 - DNA, 1491 bp, Artificial Sequence
  Description of Artificial Sequence: Synthetic coding sequence
atgaccttcaactcgtttgaaggttcgaagacctgcgtgccggccgacattaacaaggaggaggaattcgtggaggagtttaataggctcaagaccttcgccaacttcccgtcaggctcaccggtgtcagcgtcgaccctggcacgcgcaggattcctttacactggcgagggagacaccgtgcgatgcttcagctgtcacgccgccgtggatcggtggcagtatggagacagcgccgtgggtagacacagaaaagtctcaccgaattgcaggttcatcaacggtttttacctcgaaaatagcgcgactcagagcaccaactccgggatccagaatgggcaatacaaagtggaaaactacctgggatcacgcgaccacttcgcgctcgacagaccgtccgaaactcacgccgactacctgttgcggaccggacaagtcgtagacatcagcgacactatctatccgaggaacccagccatgtactcagaagaggctcggctgaagtcatttcaaaattggcccgactacgcgcacttgactccacgcgagctggcttccgcaggcctctactataccggcattggcgaccaagtgcagtgcttctgttgcggaggaaagctgaagaactgggagccttgcgaccgggcttggtcagagcacagacggcatttcccaaactgcttctttgtgctcggccgcaacttgaatattcggtccgagtcggatgcggtttccagtgacaggaatttccctaactcgaccaacttgccgagaaacccatcaatggcagactacgaagcgaggatcttcaccttcgggacttggatctactccgttaacaaagagcaactcgcgagagctggattctacgcgttgggagaaggagataaggtgaagtgctttcactgcggaggtggactgaccgattggaaaccttccgaggatccttgggaacagcatgctaaatggtaccccggctgcaagtatttgctggagcaaaaagggcaggagtacatcaacaatattcaccttactcactccctggaggaatgccttgtgcgcacgaccgaaaagaccccaagcctgactcggcgaatcgacgatactatattccagaacccgatggtccaggaggcaattcgaatgggattctccttcaaggatatcaaaaagatcatggaagaaaagatccagatctcgggaagcaactacaaatccctggaggtgctggttgccgatctcgttaacgcccaaaaggacagcatgcaggacgaatcctcccaaacctccctgcagaaggaaatttccaccgaggaacagttgagacggctgcaggaagagaagttgtgcaagatctgtatggatcgcaatatcgcgatcgtgtttgtgccatgtggccacctcgtgacctgcaagcaatgtgccgaagcggtcgacaagtgccctatgtgctatacggtcatcactttcaagcagaagatcttcatgtcc

SEQ ID NO: 33815 - DNA, 1491 bp, Artificial Sequence
  Description of Artificial Sequence: Synthetic coding sequence
atgactttcaattcatttgagggttcgaaaacttgtgtgccggctgatatcaacaaagaagaagagttcgtggaggaattcaacaggttgaaaacgttcgcgaacttcccctcaggatcgcctgtgagcgcctcaacgctcgccagagcagggtttctctacaccggagaaggagacactgtgcgctgcttctcgtgccacgccgctgtcgaccgctggcaatacggagattctgcagtgggccgccatcgcaaagtctccccgaactgccgatttatcaatggcttttacctggagaactccgctacgcagtcgactaattcgggtatccagaatggccagtataaggtagaaaactatctcgggtcccgcgaccattttgcactggataggccttccgaaacccacgctgactatctgctgcgcactggccaagtcgtcgacatctcggacactatctatccgagaaacccggctatgtacagcgaagaagcccgactcaagagcttccaaaattggcctgactacgcccatttgaccccccgcgaattggcgagcgcaggactgtactataccgggatcggggatcaggtccaatgtttctgctgtggtggcaagctgaagaactgggagccatgcgaccgcgcctggtccgaacaccgccgccacttcccgaactgcttctttgtgctgggtagaaacctgaatatccggagcgagtccgatgccgtttcctcagacaggaacttcccgaattccaccaacctgccccggaacccatcaatggccgactacgaggcacgcatcttcaccttcggtacctggatttactcggtcaataaagagcaactggcacgggctggattctacgcgctcggagagggggataaggtgaaatgtttccattgcggtggtggactcactgactggaaaccgagcgaagatccgtgggaacagcacgcaaagtggtacccgggatgcaaatacctccttgaacaaaagggccaagaatacatcaacaacattcatctgactcattcgctggaagagtgtctcgtgagaactactgagaaaacccccagcctgacccggcgcatcgatgacacgatcttccaaaacccgatggtgcaggaagcaatccggatgggtttcagcttcaaggacatcaaaaagattatggaagaaaagatccaaatctccgggagcaactacaagagcctggaagtgctggtggcagatctggtcaacgcccaaaaagattcgatgcaagatgaaagctcccagacctccctccagaaggagatatcaacggaggaacagctgcggcggctgcaggaagagaaactttgcaagatctgcatggatagaaatatcgcgattgtgttcgtcccgtgcggacacctggtgacttgtaagcagtgcgccgaagctgtggacaagtgccctatgtgctacaccgttatcacctttaaacaaaagatcttcatgtcc

SEQ ID NO: 33816 - DNA, 1491 bp, Artificial Sequence
  Description of Artificial Sequence: Synthetic coding sequence
atgacctttaattcttttgaggggagcaagacgtgtgtgcctgcagacataaataaagaggaagagtttgtggaagaatttaatagactcaaaaccttcgcgaacttcccctctggctcgcccgtttcagcatctacattggctcgagccggctttctgtatactggtgagggcgatacagtgcggtgcttcagctgccacgctgccgttgacagatggcagtacggggattccgcagttggacggcacaggaaggtctcacccaattgtcgttttatcaatgggttctatttggagaattccgcgacacaaagtaccaattcaggaattcagaacggccagtataaggtcgaaaattacctgggaagcagggaccattttgccctggaccgtccttcggagacgcacgcagattatctgctgaggacaggccaggtggtggatatttcagatacaatttaccctagaaaccccgctatgtactctgaagaggctcgactgaaatcatttcagaactggcccgattacgctcatctgacccctcgggaactggcatctgccggcctctattacaccggtatcggagatcaggtccaatgtttttgctgcggtggaaagcttaagaactgggaaccttgcgacagggcctggtccgaacataggaggcacttcccaaactgcttttttgtcttaggccgcaacctgaacatccgaagtgagtccgacgctgtgtcaagcgacaggaactttccaaactcaaccaatctgccccgcaatcccagcatggccgattacgaggctagaatcttcacctttgggacctggatttactctgtgaacaaagagcagctggcaagagcgggcttctatgccctgggagagggcgataaggtgaagtgtttccactgcggtggtggattgactgactggaagccttccgaagatccatgggagcagcatgcaaaatggtatcccggctgtaagtatctgctcgagcagaaagggcaagaatacatcaacaatatccatctaacacattccctggaggagtgtctagtgcgaacgacagaaaagactccttcacttacaaggagaatcgatgacactatcttccagaatccaatggtgcaggaagctatacggatgggcttttctttcaaggacatcaaaaagatcatggaggagaagattcaaatttccggatccaattacaagagcctagaggtgctggtggcagacctagtgaacgctcaaaaggacagcatgcaagatgaaagtagtcagacctcgctccaaaaggaaatcagcaccgaggagcaactgcggcgactgcaagaagaaaaactgtgtaagatctgtatggatcggaacatcgcaatcgtttttgtgccatgtgggcacctggtcacgtgtaaacagtgtgccgaggccgtagacaaatgtcctatgtgctataccgtgatcacgttcaagcaaaagatattcatgagc

SEQ ID NO: 33817 - DNA, 1491 bp, Artificial Sequence
  Description of Artificial Sequence: Synthetic coding sequence
atgacctttaactcctttgagggaagtaagacctgcgtgcccgctgacatcaataaagaggaagaattcgtggaggagtttaataggctgaaaaccttcgctaattttccatccggtagccctgtctcagcgagcaccctcgcccgcgctggatttttgtacacgggtgagggcgatactgtgcggtgcttctcctgccacgccgccgtcgatagatggcagtatggagactcggccgtgggacgtcatcggaaagtttcccccaattgccggtttatcaacggattctacctagagaactcagccacccagtctaccaactcaggcatccaaaacggccagtacaaagttgagaattacctcggctccagggaccatttcgcgctcgacagaccaagtgaaacgcacgccgactacctcctcaggacagggcaggtggtggacatttccgacacgatctatcctcggaacccggcgatgtacagcgaggaggctcggcttaaatcctttcagaactggcctgattatgctcatttgacccctcgagagctggcctctgctggcctgtattatactgggataggcgaccaggtgcaatgcttctgctgtggtggtaagctcaagaattgggaaccatgtgaccgcgcgtggagtgagcaccgccgacattttcccaattgctttttcgtccttggtcgcaatcttaacatcagatctgagtccgacgcagtttcctcagaccgcaatttcccgaatagcaccaacttgccgcggaatcctagcatggcggactacgaggcacgcatcttcacattcggaacttggatttactcagtgaataaggagcagctggcaagagcaggcttctacgcactgggcgaaggcgacaaagtgaagtgcttccactgcggcggcggtctcactgactggaaaccttcagaagatccatgggaacagcacgctaaatggtaccccgggtgtaaatacctgttggaacaaaagggacaggagtatataaataatatccatctgacgcactccctagaagaatgcctcgtgcgaaccactgagaagaccccctcactcacacgacgcatcgatgacaccatctttcagaaccccatggtgcaggaggccattaggatggggttctcattcaaggacataaaaaaaatcatggaggaaaagatccagatctctgggtccaattacaagtctttggaggtgctggtggccgatctggtgaacgcacagaaggacagtatgcaggacgaatctagccaaaccagcctgcagaaggaaatctctacagaggaacaactgaggcggctgcaggaggagaagctctgtaagatttgcatggacagaaacatcgctatagtgtttgtgccgtgcggacatctggtcacttgtaagcagtgcgctgaggccgttgataaatgccctatgtgttacactgtcatcacttttaagcagaaaatctttatgtcc

SEQ ID NO: 33818 - DNA, 1491 bp, Artificial Sequence
  Description of Artificial Sequence: Synthetic coding sequence
atgaccttcaactcgttcgaaggctcaaagacctgcgtgccagcagatatcaataaggaagaagagttcgtggaagaattcaacagacttaagacttttgctaactttccttccggatcaccagtgtcggcgagcactctggctcgggcaggattcctgtacaccggggaaggagatactgtccggtgcttctcatgccatgcagcagtggacaggtggcaatacggggatagcgcagtcggacgccaccgcaaggtgagccccaattgtcgctttatcaacggattctacctcgagaactcagccacccaaagcaccaactcaggtattcagaacggacaatacaaagtggagaactacctcggctcacgcgaccactttgcgctcgaccggccctcggaaacccacgcggattacctgctccgcactggacaagtggtggacatctcagacaccatctacccgcggaacccagccatgtacagcgaagaagcccggctgaagtcctttcagaattggccagactatgcccacctgacgcctcgcgagctggcatcggccgggctgtactacactggcatcggggaccaagtgcaatgcttttgctgcggcggcaagctcaagaactgggaaccatgtgatagagcgtggtcggaacaccgccggcacttcccaaactgcttcttcgtcttgggacgcaatctcaatatccggagcgaaagcgacgctgtctcgtcggacagaaacttcccgaatagcactaacctcccgagaaacccgtcaatggccgactatgaggcacgcatcttcacctttggtacttggatttacagcgtgaacaaagaacaactggcccgcgctggtttttacgcattgggtgaaggagataaggtgaaatgttttcactgcggtggaggccttaccgactggaagccttccgaagatccgtgggagcaacacgccaagtggtacccgggttgtaagtaccttctggaacagaagggccaagagtacatcaacaacatacatctgacccactctctcgaagaatgcctcgtgaggaccaccgagaaaacgccgtcactgactcgacggattgatgatactatcttccagaatccaatggtccaggaggccatccgcatgggattctcattcaaagacattaagaagattatggaggaaaagatccagatttcgggaagcaactacaaatccttggaagtcctcgtcgcagacctcgtgaacgcacagaaggattccatgcaggatgagtccagccagacttcgctgcagaaagaaatctcaactgaggagcagttgcggagactgcaggaagaaaaactgtgcaagatctgtatggaccggaacatcgccatcgttttcgttccgtgtggacatctggttacttgcaaacagtgcgctgaagcggtggacaagtgcccaatgtgttacaccgtgattacctttaaacagaagatcttcatgtcg

SEQ ID NO: 33819 - DNA, 1491 bp, Artificial Sequence
  Description of Artificial Sequence: Synthetic coding sequence
atgaccttcaattccttcgaggggtccaaaacatgcgttccagccgacatcaataaagaggaggaatttgtagaggaatttaaccggctgaaaacgttcgctaattttccatctggctcacccgtgtcggcatcaacactcgcacgggctggcttcttgtacaccggagagggtgacactgtgaggtgcttctcttgccacgccgccgtggatcggtggcagtatggcgattccgcagttggtcgccaccgcaaggtcagcccaaactgtagattcatcaacgggttttatttggagaacagtgccacccagtccaccaattctggaatccagaatggtcagtataaagtggagaattacctgggatccagagatcattttgctttggatcgaccctctgaaacgcatgccgactatttgctgcggactggtcaggtggtggacatttccgatactatttatccccgaaacccagctatgtatagcgaggaagcacgcctgaagtcctttcagaattggcctgattacgctcatctgactccccgagaactggcttctgctggactgtattacaccgggatcggtgaccaggtgcagtgtttttgttgtggcggcaaactcaaaaattgggagccctgtgacagagcttggagtgagcatcgccgccacttccccaattgcttctttgtacttggccgcaacttaaacattcggtccgagtccgatgcagtgtcctccgataggaactttccaaactccactaatctacctcgtaatcctagcatggccgactatgaagcgagaattttcacttttggcacctggatttattccgtgaacaaggaacagcttgcccgcgcggggttttatgcactcggcgagggcgacaaggtaaagtgtttccattgcggaggtggactgactgattggaaaccctctgaagacccttgggagcagcatgcaaagtggtaccccgggtgtaaatacttactggaacagaagggccaggaatatatcaataatatccatttaacccacagtttggaggagtgcctcgtaagaactacagaaaagacaccttccttaactcgcaggattgatgataccatcttccagaatcctatggtgcaagaagcaatccgcatgggcttctcctttaaagatattaaaaaaatcatggaggagaagatacaaatttcaggtagtaattacaagtcactggaagtgctggtcgcagacctagtgaacgcccagaaggattcaatgcaggacgagtcttcccagacatcgctccagaaggaaatttccactgaggagcagctgcgaagactgcaggaagaaaaactgtgcaaaatatgtatggatcgtaatatagccattgttttcgttccttgcggccatctggtaacctgcaaacagtgcgccgaggccgtagataagtgtcccatgtgttacacagttattacatttaagcagaagatttttatgtct

SEQ ID NO: 33820 - DNA, 1491 bp, Artificial Sequence
  Description of Artificial Sequence: Synthetic coding sequence
atgaccttcaactcgttcgaaggatccaagacctgcgtgcccgccgatatcaacaaggaagaagagtttgtcgaagaattcaaccgcctgaaaacgttcgcaaacttcccgtcaggatcgcctgtctccgcgagcacccttgctcgtgcaggatttctgtacactggagaaggagacaccgtgcggtgttttagctgccatgccgcggtggaccggtggcaatacggggacagcgccgttggccgccatcgcaaggtgagcccgaattgcagatttatcaatggattctacttggagaacagcgcaacccagagcactaattccggtattcagaacggacagtacaaggttgagaactacctcggatcgcgggaccacttcgccctggaccggccttccgaaactcacgcggactacctcctcagaactggccaggtggtggacatcagcgatactatctacccgagaaatcctgccatgtacagcgaggaggcccgcctgaagtcattccagaactggcctgactacgcccaccttactccgagagaactcgcaagcgccggcctctactacactggaatcggtgaccaagtgcagtgtttttgctgtggaggaaagctgaagaactgggagccgtgtgacagagcgtggtccgaacaccgccgccactttccaaattgcttctttgtgctgggtcgcaacctgaacatccggtcggagtcagacgcggtgtcgtccgaccggaacttcccgaactcaaccaatctccccaggaatccatcaatggcggactacgaggcgcggatcttcactttcggcacctggatctactcagtgaataaggagcaactggcgagagcaggattttacgccctgggggagggcgacaaagtgaaatgtttccactgcgggggcggattgactgactggaaaccgtccgaggacccctgggaacagcacgccaaatggtaccccggatgtaagtacctgctggaacaaaaaggacaggaatacatcaacaatatccacctgactcatagcctggaggaatgtcttgtgaggaccactgagaaaactccctcactgactcggagaatcgatgacaccattttccaaaatccgatggtgcaggaagcgatccgcatgggcttttcctttaaggatatcaagaaaatcatggaagagaaaatccaaatctccggatctaactacaagtccctggaagtgctcgtcgcagatctggttaatgcacagaaggatagcatgcaagacgaatcgtcgcaaacctccctccaaaaggagatctcaaccgaggaacagctgagaaggctgcaagaagagaagctctgcaagatctgcatggaccgcaatatcgctatcgtgttcgtgccctgcggacatctggtcacctgtaagcagtgtgccgaagctgtggacaagtgcccaatgtgctacaccgtgatcactttcaagcagaagatcttcatgtcg

SEQ ID NO: 33821 - DNA, 1491 bp, Artificial Sequence
  Description of Artificial Sequence: Synthetic coding sequence
atgacctttaactccttcgaaggcagcaagacttgcgtgcctgcagatatcaataaggaagaggaatttgtggaagaattcaacagactcaagaccttcgccaacttcccttcgggttccccagtttcggcatcgactcttgccagggcggggttcctgtatactggagagggcgacaccgtcaggtgtttctcgtgtcatgcagctgtggataggtggcagtacggagacagcgcagtcggacgtcataggaaagtgtcccctaattgtagatttatcaacggattctacttggaaaacagcgcaactcagtccaccaattctggaatccagaacggccagtacaaagtggaaaactacctgggatcgagggatcacttcgcgctcgatagaccttcggaaacgcacgcagactacctgcttcgcacgggacaagtggtggatatctccgatactatctatccgcgaaatcctgccatgtacagcgaggaggcccgactcaagtcctttcaaaactggcccgactacgcacatcttacccctcgcgaactcgcgagcgctggtctgtactatactggaatcggagatcaggttcaatgcttttgctgtggggggaaactgaagaactgggaaccctgcgaccgggcatggtcggaacatagacggcactttcctaattgtttctttgtgctggggaggaacctcaacataagatcggaatcagacgcggtgtcaagcgacagaaacttccccaacagcacgaacttgcctcgcaatccaagcatggcagactacgaggcccgcatctttactttcggaacttggatttactctgtcaataaagaacagctcgcacgcgcagggttctatgctctgggagaaggggacaaggtgaaatgctttcattgtggaggtggcctgactgattggaagccaagcgaggatccgtgggaacaacacgcaaagtggtacccagggtgtaagtatctgctggagcaaaaaggtcaagagtacattaacaacatccatcttacccattcattggaggaatgccttgtccgcaccaccgaaaaaaccccgtcgctgaccagacgaatcgatgataccattttccaaaacccaatggtgcaagaagctattcgtatgggattctcatttaaggacatcaagaagattatggaagaaaagattcaaatcagcggctctaattacaagtccttggaagtgctggttgcagacctggtgaacgctcagaaggatagcatgcaagatgaatcgtcccagacgtcccttcaaaaggagatttccaccgaagaacagctgcggcgactccaagaggaaaagctgtgcaagatttgcatggacagaaacatagcgatcgtattcgtcccctgtgggcatctggtgacctgtaaacaatgtgccgaggccgtggataaatgtcccatgtgttacactgtgatcaccttcaagcaaaagatctttatgtca

SEQ ID NO: 33822 - DNA, 1491 bp, Artificial Sequence
  Description of Artificial Sequence: Synthetic coding sequence
atgacttttaactcgtttgaagggagcaaaacttgcgtgcccgctgacattaacaaagaggaagaatttgtggaagaattcaatcggcttaagacgtttgccaactttccaagcggatccccagtgagcgcatcgaccctggctcgggcgggattcctctacactggggaaggtgatactgtgcgctgtttctcgtgtcatgcagcagttgatcgatggcagtacggagactcagccgtcggacgacatcgcaaggtttcgcctaattgtcgatttatcaacggtttctacctggagaattcagcaactcaaagcaccaactcaggcatacagaatggccagtacaaggtggaaaactacctgggttcaagagatcatttcgcgctcgaccgaccgtccgaaacccatgcagattaccttcttcgcaccggccaagtcgtggacatttccgataccatctaccctcgaaacccagcaatgtactctgaggaagctcgactgaaatcctttcagaactggcctgactacgcacacctgaccccccgggaactcgcaagcgcaggactctactacacgggcattggagatcaggtgcaatgcttctgttgcggtggtaagttgaagaattgggaaccttgtgaccgtgcatggtcagaacatcgtcggcacttccctaactgttttttcgtccttggtagaaacttgaatattcggtccgagtcggacgccgtctcttcggaccgtaactttccgaacagcactaatcttccccgtaatccaagcatggctgattacgaggcacgcattttcaccttcggcacctggatttactccgtcaataaggagcagctggcacgtgccggtttttacgcacttggggaaggcgataaagtgaaatgcttccattgcgggggaggactgacggattggaaacccagcgaggatccttgggagcaacacgccaagtggtatcctgggtgtaagtatctgcttgaacaaaagggccaggagtatatcaacaatatccacctcacccactcgcttgaagagtgtcttgtgagaaccactgagaaaactccttccctgactcgaagaatagatgacaccatttttcagaatcccatggtgcaagaagcgatccgtatgggcttttcgtttaaggatatcaagaagattatggaagaaaagatccaaatcagcggaagcaattacaagagcctcgaagtgcttgtcgcagacctcgtcaacgcccaaaaagatagtatgcaagatgaatcgtcacaaacgtcactgcagaaggaaatttccaccgaggaacagcttagacgcctccaagaggaaaagctgtgtaagatttgtatggatcgtaacatcgcgatcgtctttgtgccatgtggccatctcgtcacctgtaaacaatgcgctgaggcagtagataagtgcccgatgtgttacactgtgataacttttaagcaaaagatctttatgtcg

SEQ ID NO: 33823 - DNA, 1491 bp, Artificial Sequence
  Description of Artificial Sequence: Synthetic coding sequence
atgaccttcaactcgttcgaaggctcaaaaacttgcgtcccggccgacatcaataaggaagaggaattcgtggaagagttcaatcggctgaaaacctttgcaaacttcccaagcggatccccggtatcagcctcaacccttgcacgggcgggcttcctctacactggtgaaggcgataccgtgcgctgcttcagctgccatgcggccgtcgatagatggcagtacggggactcagctgtggggcgccaccgaaaggtgtcaccgaattgtagattcatcaacggattctacctggagaatagcgccactcagtcgactaactcggggatccagaacggccagtacaaggtggaaaactatctgggctctagggatcacttcgcccttgatcggccgtccgaaacccatgcggactacctccttcgcaccggacaagtggtggacatctcagatacgatctacccccggaatccggcaatgtacagcgaagaagctagactgaagtcattccagaattggccggactacgcccacctgacgccacgcgaactcgcgtcggctggactgtattacaccggaatcggtgaccaagtgcagtgcttttgctgcggcggaaagctgaagaactgggaaccttgcgaccgcgcgtggtcggaacatcggaggcactttccaaactgcttttttgtgcttggacggaacctcaatatcagaagcgaaagcgatgccgtgtcctccgacagaaacttcccaaactccactaatctcccgcgaaatccatcgatggctgactacgaggctcgcatcttcactttcgggacctggatctattccgtcaacaaggaacagctggctagagcgggattctacgcgctgggcgaaggcgataaagtgaaatgctttcactgcggaggaggtctgactgactggaagccgtccgaagatccgtgggagcagcacgcaaagtggtatccgggctgtaagtacctgcttgaacaaaagggacaggagtacattaacaatatacatctcactcactctctggaggaatgcctcgtccggaccactgaaaagactccgagccttactcggagaatcgatgacactatcttccaaaaccctatggtgcaagaagcaattagaatgggattctcatttaaggatatcaagaaaatcatggaagagaaaattcaaatcagcgggtcgaactacaagagcctcgaagtgctggtggccgacttggtgaatgctcagaaggactcaatgcaggacgagtcatcccaaactagcctccagaaggagatctcgactgaagagcagctcagacggctgcaggaagagaagctgtgcaaaatctgcatggatcgcaacatcgccatcgtctttgtgccttgcggccacctcgtgacttgcaaacagtgcgccgaagcagtggataaatgccccatgtgttataccgtgatcacctttaaacagaaaatcttcatgtcg

SEQ ID NO: 33824 - DNA, 1491 bp, Artificial Sequence
  Description of Artificial Sequence: Synthetic coding sequence
atgacgttcaatagctttgaagggagcaagacctgtgtgccagctgatatcaacaaggaggaagagtttgtggaagagtttaatcgccttaagacttttgcgaattttcctagcggatccccggtgagcgcatcgactcttgcgagagcaggatttctgtacaccggcgaaggtgacactgtgcgctgcttctcgtgtcatgccgcagttgatcgttggcaatacggcgactcagcagtgggacgccataggaaggtgtccccaaattgtcgcttcattaacggtttctacctggagaactcagccactcaatccactaactcaggaatccagaacggtcagtacaaagtggagaactacctcggatcgagagatcactttgcgcttgatcgcccatccgaaacccatgccgattacctcctccggactggacaagtggtcgatatctccgatacgatatacccacggaatcccgccatgtactccgaggaagcccgactgaagtccttccaaaattggcccgactacgcacatcttactcctagagaacttgctagcgcagggctttactacaccggtatcggcgatcaggtccaatgtttttgttgtggaggtaagctgaagaactgggaaccttgtgatcgcgcatggtccgagcatcggagacattttcctaattgtttctttgtcctggggcgtaatctgaacattcgctcggaatcggatgcagtgtcaagcgatcggaactttcctaactcgacgaacctcccaagaaacccctcgatggcagactacgaagcacgaattttcacttttggaacttggatttactcggtcaacaaggaacaactcgcacgtgcaggtttttacgccctgggtgaaggtgacaaggtgaagtgtttccattgtgggggtggtttgaccgattggaagccttcggaagatccttgggaacaacatgcgaagtggtaccctggttgtaagtacctgttggaacagaagggtcaagaatacattaacaacatccatcttactcattcccttgaggaatgtttggtgagaactaccgaaaagactccctcgcttaccagacggatcgacgataccatttttcaaaaccctatggtccaggaagccattagaatgggtttctcctttaaggatatcaaaaagatcatggaggagaagatacaaatctcaggatccaattacaagtcccttgaagtgcttgtggccgatctcgtgaatgcacaaaaggactccatgcaggatgaaagctcccagacctcacttcaaaaagaaatctcaaccgaagaacagcttaggagactgcaggaagagaaactgtgcaagatttgtatggatagaaacatcgcaattgtgtttgtgccatgtggacacctcgtgacctgtaaacagtgtgcagaagcggtcgataagtgtcctatgtgctacacggtgataacctttaagcagaagatctttatgtca

SEQ ID NO: 33825 - DNA, 1491 bp, Artificial Sequence
  Description of Artificial Sequence: Synthetic coding sequence
atgacattcaactctttcgaaggctcaaaaacctgtgtccctgctgacatcaataaggaagaagaattcgtcgaagagtttaatcggctgaagacgtttgccaattttccttcaggttctccggtctctgctagcacattagccagggctggtttcttgtacacaggggagggggacacagtacggtgcttttcctgccacgcagccgtcgacaggtggcagtatggcgattctgccgttggcagacataggaaggtctcacccaactgcagatttatcaacggtttttaccttgagaacagtgccacgcagtccactaatagtggaattcagaatgggcagtataaggtcgaaaactacctgggctcgagggaccactttgcgctggaccgaccatccgaaactcatgcagactatctgcttagaactggccaggttgtcgatattagtgacacaatatatcctaggaaccctgccatgtattctgaagaggccaggctgaaatctttccagaattggccagactatgcccacttaacgcctagagagctggctagcgcgggactttattataccggaatcggggaccaggtccagtgcttctgctgcggggggaaacttaaaaactgggaaccttgtgatcgagcttggtcggagcataggaggcacttcccaaactgcttttttgtgctcggtagaaacctcaatattcgctccgaaagcgacgctgtatcaagcgataggaatttccccaactctaccaaccttccgcgcaacccctctatggcagattatgaagcgaggattttcacatttgggacttggatttattcagtcaacaaggagcagctggccagggccggcttctacgctctgggagaaggtgataaggtgaaatgcttccattgtgggggagggttgaccgactggaagcctagtgaagacccttgggagcaacacgccaaatggtaccccgggtgcaaatatttgttggagcagaagggacaggaatatattaacaatatccacttgacccacagcctcgaagagtgtctagtcagaactactgagaaaactccctccctcactaggaggatagacgataccatttttcagaacccaatggtgcaagaagccatccgcatgggctttagctttaaggatatcaagaagattatggaagaaaaaatccagatctctggaagcaactacaaatcccttgaagtgctagttgctgatctcgtgaacgcgcagaaagactccatgcaggacgagtcaagtcaaacctccttgcagaaagagatctcaacagaggaacaactgcgaaggctgcaggaagagaaactttgtaagatctgtatggacaggaacattgctattgttttcgtgccttgtggtcatctcgttacgtgtaaacaatgtgccgaagcagtggacaagtgccccatgtgttatacggtcattacctttaaacaaaagatatttatgtcc

SEQ ID NO: 33826 - DNA, 1491 bp, Artificial Sequence
  Description of Artificial Sequence: Synthetic coding sequence
atgacgtttaattcttttgaggggagcaagacctgtgtaccagctgacatcaataaagaggaagaatttgtggaggagtttaatagattgaaaaccttcgctaattttccatctggctcacccgtgtctgcgagcacactggcgcgggcaggcttcctgtatacgggtgagggtgatactgtgagatgtttcagctgtcacgctgccgtggatcggtggcaatacggcgacagtgctgttgggcggcatcgcaaggtgtcccctaactgtcggttcatcaatggtttctacttagagaatagtgcgacacaaagcactaacagcgggattcagaatgggcaatataaagtagaaaactacctcgggagccgcgatcatttcgctttggaccggccaagtgagactcacgcagactatctccttaggactggacaggtggtggatattagcgataccatttaccctagaaaccccgccatgtattccgaggaagccaggttgaagtcctttcaaaattggcctgactacgctcatttaaccccacgggaattagcctcagctggcctctattacactggaattggggaccaagtccagtgtttctgttgtggtggaaaattgaagaattgggaaccttgtgatcgcgcgtggtccgaacatcggaggcattttcccaactgtttcttcgtcttaggacggaacctgaatatcaggagcgagagcgatgccgtgtcctcagaccggaatttccccaatagtacaaacctgccacggaaccctagcatggccgactatgaggcacgcatattcacttttggtacttggatctacagtgttaacaaagagcagcttgcgcgcgcagggttctacgccttgggtgagggtgacaaagtcaagtgcttccactgcggaggaggcctgacagactggaagccctccgaagacccatgggaacagcatgctaagtggtatccaggctgtaaatatctccttgagcagaagggacaggagtacattaacaacatccatttgacgcactcgttggaggagtgtctagttcggacaacagagaaaacgccatcgctgacaagaagaattgacgacaccatatttcagaatccgatggtgcaggaggcaatccgaatgggtttctcatttaaagatataaagaaaattatggaggaaaagatccagatctccgggagcaactataaaagtctggaagtgctagtggccgacctcgtgaatgctcaaaaggactcgatgcaagatgagtcctctcagaccagtctgcagaaggagatttcaactgaagaacagctcaggagactgcaagaggagaagctatgtaagatctgcatggatcgcaacatcgcgatagtcttcgttccgtgcggccacctggtgacctgtaagcagtgcgccgaggccgtcgataagtgccctatgtgctacacggtaatcacatttaagcagaaaattttcatgtca

SEQ ID NO: 33827 - DNA, 1491 bp, Artificial Sequence
  Description of Artificial Sequence: Synthetic coding sequence
atgacctttaactcttttgagggttccaagacctgtgtccccgcagacataaacaaagaagaggagttcgtggaagagttcaaccggctgaagacattcgctaactttccatcagggagcccagtctctgcctctaccctggcaagggcaggattcttgtataccggcgaaggcgacacagttcgatgcttttcatgtcatgcagcagtggaccggtggcagtatggcgattcggcggtcgggcggcacaggaaggtctcacccaactgcaggttcattaatggtttctatttggaaaactcagctactcagagtaccaattccggcattcagaatggccagtataaagtggaaaattacctcggatcccgggatcatttcgcactagaccgtccgtccgagacacacgcagactatcttctgcgtaccggccaggtcgttgacatatctgatacaatatatccccgaaacccggctatgtactcagaggaagcgcggctcaaaagctttcaaaactggccagattacgctcatctcactccccgtgaactcgcctccgctggcctgtactacacggggattggggaccaggtccagtgtttttgttgcggtggcaagctgaagaactgggagccctgcgaccgcgcgtggagtgaacaccggagacattttccaaactgtttctttgtacttgggcgtaacctgaatattagaagtgagagcgacgcagttagtagcgaccggaattttcccaacagtaccaatctgcctaggaatccctctatggctgattacgaggctagaatttttaccttcgggacgtggatatactcggtgaataaagagcagttggcccgggccggcttttatgccctgggcgaaggcgacaaagtgaagtgttttcactgtgggggagggctgaccgactggaaaccatcagaagacccttgggagcagcatgctaagtggtatcctggctgcaaatatctgctcgagcaaaaaggtcaggaatacattaataacattcacctgacccattccctagaagagtgcctggttcgcactaccgagaaaacgcccagccttacacggcggattgatgataccatcttccaaaaccccatggtccaggaggctattcggatggggttttcattcaaggacattaagaagattatggaggaaaaaattcaaatatccggaagcaattacaaaagtctggaagtcctggtcgcagatctggtcaacgcccagaaggattccatgcaggatgagagctctcagacctctttacagaaagaaatttccaccgaagagcagcttagacgcctgcaggaggaaaagctttgcaagatttgcatggacagaaatatcgctatcgtgtttgtcccatgtggtcacctggtcacctgcaaacaatgcgctgaagccgtcgataagtgccctatgtgttacacagtcatcaccttcaagcagaagatattcatgtca

SEQ ID NO: 33828 - DNA, 1491 bp, Artificial Sequence
  Description of Artificial Sequence: Synthetic coding sequence
atgacttttaattcattcgaggggagcaaaacctgtgtgcccgcagatattaataaagaagaagagtttgtagaggagtttaacagattaaaaacttttgccaacttcccctcgggttctcccgtgagcgcaagcacactcgccagagcaggatttttatacaccggagagggtgatactgtcaggtgtttctcttgccacgcagccgttgaccgatggcagtacggagacagcgctgtcggacgccaccgcaaggtttcaccgaactgcagatttatcaatggattctatctcgagaattctgctactcagtccacaaactccggtatccagaatggccagtacaaggtggaaaattatctcgggtcccgggaccattttgccctcgatcggccttccgagacccacgcagattacctgttgcgaaccggccaggttgttgatattagtgacaccatttaccctcgaaaccccgctatgtacagcgaggaagctagactgaagagctttcagaattggcccgactacgcccatctgaccccgagagagttggcatccgctggcctgtattacaccgggataggagatcaggtacagtgcttttgctgcggagggaagctcaaaaactgggagccctgtgaccgagcctggtccgagcataggaggcacttcccaaattgtttcttcgtactggggaggaacctaaacatcaggtctgagtccgacgcagttagttcggaccggaactttcccaactcaacgaatctgccgagaaacccttctatggccgactatgaggctaggatttttacgttcggcacctggatttatagcgtgaacaaggagcagctagcaagagctgggttttacgccttgggggaaggggacaaagtgaagtgttttcactgcggtgggggtctcacagactggaaaccgtcagaggatccttgggaacagcatgccaagtggtaccctggctgcaaatacctgttggagcagaagggccaggagtacatcaacaatatacacctcacacacagtctggaagaatgcctggttcgtaccacggaaaagaccccttcactcacgcggaggatagatgataccatctttcagaacccaatggtgcaggaggccattcggatgggattctccttcaaagacattaagaaaatcatggaggagaagatccagatttcaggttctaactataagagcctcgaagtgcttgttgcagacctagtgaacgcacaaaaagatagcatgcaggacgaatcctcacaaacaagcctgcagaaggaaatctccaccgaggaacagctgcggcgcctacaagaggaaaaactctgcaaaatttgcatggatcgtaacattgccattgtgtttgtgccgtgcggacacctggttacttgtaaacaatgtgccgaagccgtcgacaagtgccctatgtgctacaccgtaatcaccttcaagcagaagatattcatgtcg

SEQ ID NO: 33829 - DNA, 1491 bp, Artificial Sequence
  Description of Artificial Sequence: Synthetic coding sequence
atgaccttcaattcttttgaaggatctaaaacctgcgttcctgctgacattaataaggaagaggaattcgtggaggaatttaacaggctgaagaccttcgcaaactttccttccgggtcccccgtgtccgcctctaccctggctcgcgccgggttcctctataccggggaaggcgacaccgtcaggtgtttctcttgccatgccgccgtggacagatggcagtacggggatagtgctgtcgggcggcaccgaaaggtgtcgccaaactgcaggtttattaacgggttctatctggagaacagcgccacgcagtcaacaaactctggtattcagaacggacagtacaaggtggaaaattacctggggtcacgcgatcatttcgcactcgatcgaccgtccgagacccacgctgactacctgttgagaacgggacaggtggttgatatctcagatactatctatcccaggaaccctgccatgtacagtgaggaggctcggctgaagagtttccagaattggcccgattacgcccacctgacaccacgcgaacttgcaagcgctggactctattacacgggaataggcgaccaggtccagtgcttttgctgcggtgggaagctcaagaactgggagccatgcgatcgagcctggtcagaacaccggaggcacttccctaactgcttcttcgtgctaggacgtaaccttaatattcggagcgaaagcgacgcggtgtcctccgacagaaacttccctaattcaactaacctgccacggaaccctagtatggcagactatgaagctcgaatctttacattcggcacgtggatctacagtgtcaacaaagagcagctggcacgggctggtttctacgccttgggcgagggtgacaaggtgaagtgtttccattgcggaggcggacttacagactggaaacctagtgaggacccctgggagcagcatgctaagtggtatcctggatgtaaatacttgctggagcaaaagggtcaggagtatataaacaatatccacctgacacacagcctggaagagtgcctggttaggaccactgaaaagactcccagcctgactcgccggatcgacgataccatttttcagaaccccatggtacaggaggccatccggatgggtttcagcttcaaggacatcaagaagataatggaagaaaaaattcagattagcggaagtaattacaagtctttagaggtccttgtagcagacctcgttaacgcccagaaggactccatgcaggacgaatcttcacagacctcattgcagaaggagatctccaccgaggaacagctgcggaggctccaagaagaaaaactgtgcaagatctgcatggaccggaacattgccatagtattcgtcccctgcggccacctagtgacctgcaagcagtgtgccgaagccgtcgacaagtgtccaatgtgctatactgttatcactttcaaacagaagatctttatgagt

SEQ ID NO: 33830 - DNA, 1491 bp, Artificial Sequence
  Description of Artificial Sequence: Synthetic coding sequence
atgacttttaactcttttgaaggaagtaaaacatgcgtgccggccgacattaacaaggaggaggaatttgtggaagaattcaaccgtctgaagaccttcgcgaactttccctcgggttccccagtatcagccagtactttggcccgagcgggttttctgtacactggagaaggagatactgtcagatgcttctcctgccatgctgcggtagacaggtggcaatacggagatagtgcagttgggaggcacagaaaggtgtcccccaattgtcgcttcataaacggattctatctcgaaaatagcgctacccagtccactaactctggtatccagaatggtcaatataaagttgaaaactacctaggtagccgtgatcactttgccttggacagaccttcagaaactcatgccgattaccttcttcgaaccgggcaagttgttgatattagcgatactatctatcctcgtaatcctgccatgtatagcgaagaggccaggctgaagtcttttcaaaattggcctgattacgcccacttgacaccaagggagttggcatcagcaggtttatactatacaggcattggtgatcaagtccaatgcttttgctgcggaggtaaattgaaaaattgggaaccttgcgatagagcctggtctgaacacaggcggcactttcccaactgctttttcgtcttgggcaggaacttgaacataaggtctgaatccgatgccgtaagctctgaccgtaatttcccaaatagtactaatttgccccggaacccatcgatggcagattatgaagcacgcatctttacctttggtacttggatctattcagtgaataaggagcaattagctagagccggcttctacgctcttggtgagggagataaggttaagtgtttccattgcgggggtggacttactgattggaagccaagtgaggatccttgggaacaacatgccaagtggtaccctggatgcaagtaccttctcgagcaaaaaggacaagagtatatcaataatatacatctcactcactcattggaggaatgtctcgtcaggactactgaaaaaacgccttccttgacaaggaggattgatgacactattttccagaacccaatggttcaagaagctattagaatgggatttagctttaaggatataaagaagatcatggaggaaaagatccaaatatctggtagcaactataaatccctcgaggttcttgttgcggatcttgttaatgcccaaaaggatagcatgcaagatgaaagcagtcaaacgagcttgcaaaaggaaattagtactgaggaacagctcagacgtttgcaagaggagaagctctgtaaaatttgcatggacaggaacattgctatagtgttcgttccatgtggtcatttggttacttgtaaacaatgtgctgaagccgtggataagtgtcccatgtgttatacagttatcacgtttaaacagaagatttttatgtcc

SEQ ID NO: 33831 - DNA, 1491 bp, Artificial Sequence
  Description of Artificial Sequence: Synthetic coding sequence
atgacatttaattcgtttgaaggcagtaagacctgcgtccctgccgatattaacaaggaggaggagttcgtagaggaattcaaccggctgaagaccttcgccaacttcccaagcgggtcccctgtttcagcatctacactggctcgtgcaggattcctttacacaggcgagggcgataccgtgagatgcttctcctgtcatgccgccgtcgaccggtggcaatacggggactccgctgtgggacggcacaggaaagtatccccaaactgcagatttataaacggcttctacctagagaatagcgcaacccagtctactaacagcggtatacagaacggtcagtataaggtggaaaattatctgggctccagagatcacttcgctctggaccgtccatcagagacccacgctgattatcttctgaggactggccaggtcgtagatatctctgacacgatctatcctcgaaaccctgctatgtattctgaggaagcacgcttgaagagcttccaaaattggcccgattatgcacacttaactccccgagagctggcatctgccggtctctattatacaggcataggagatcaggttcagtgtttctgctgcggaggtaaacttaaaaattgggaaccttgcgaccgagcatggagcgaacacagaaggcattttcccaattgctttttcgtcttgggacgtaacctgaacatccggagcgaatctgatgccgtgtcaagtgacaggaattttccgaattccaccaatctcccccgtaatccatccatggcagattacgaggcaagaatttttacgtttgggacatggatttacagcgtaaacaaggaacagctggctcgggcgggcttctatgctctgggggaaggcgacaaagttaaatgtttccactgcggaggggggctgacagattggaagccctctgaggacccttgggaacagcacgccaagtggtaccccggatgtaaatatctgctggaacagaaagggcaggaatacataaacaatattcaccttacacacagcctggaggagtgcttggttcgcaccactgaaaagaccccctcactcacacgtcgcattgacgataccattttccaaaatcctatggtccaggaagcaatcagaatggggtttagtttcaaagacattaagaaaattatggaggagaaaatccagatctcgggctccaattataaatccctggaagtattggtcgccgaccttgtgaacgcgcagaaggatagtatgcaggacgagtccagtcaaaccagcctccaaaaagagatctctacagaggaacagctgcgtcgcctacaagaagaaaagctgtgtaaaatctgtatggatcggaacattgctatcgtttttgtaccttgtgggcacttagtgacttgtaaacaatgcgccgaggcagttgataagtgtcctatgtgctataccgtaatcacctttaaacaaaagatatttatgagc

SEQ ID NO: 33832 - DNA, 1491 bp, Artificial Sequence
  Description of Artificial Sequence: Synthetic coding sequence
atgactttcaactcgtttgaaggatccaaaacctgtgtcccagcagatatcaacaaggaagaagaatttgtggaagagtttaatcgcctcaagactttcgccaacttcccgtccggatcgcccgtgagcgcaagcactctcgcaagggctggcttcctgtacaccggagaaggcgataccgttagatgtttttcctgtcacgcagcagtggatagatggcaatacggtgactctgcggtgggcagacaccggaaagtctcgcctaattgcaggttcataaatgggttttatctcgaaaattctgcaacccaaagcaccaacagcggcatccaaaatggccaatacaaagtcgagaattaccttggctcgagagatcacttcgcgttggacaggccctcggaaacccatgccgattacctcctccgtactggtcaggtcgtggatatctcggacacgatttaccctcgcaaccccgcgatgtactccgaggaggcaagactgaagagctttcagaattggccggactacgcccatcttacccctagggaactcgcatcggcaggcctttactataccggaattggggaccaagtgcaatgcttctgttgtgggggaaaacttaagaactgggagccctgtgacagagcatggtcggagcatcgtagacatttcccaaactgtttcttcgtgctcggacggaacctcaacatccgctccgaatccgacgcagtgtcatcagatagaaactttccaaattccactaatctccctagaaaccctagcatggccgactacgaagcccggattttcacttttggaacctggatctactccgtgaataaagagcagcttgcgcgcgcaggcttttacgcactgggtgaaggagacaaggttaaatgctttcattgtggaggaggcctgactgactggaaaccttcggaggacccatgggagcagcacgccaagtggtatcccggctgtaagtacctgctggagcaaaaaggacaagaatacatcaacaatattcatctgacccattcgcttgaagaatgcctcgtgagaactaccgaaaagaccccatcgcttacgcgacggatcgatgacactattttccagaacccgatggtccaggaagcaattcgcatgggtttctcgtttaaggacattaagaaaatcatggaggaaaagatacagatcagcggttcaaactacaagtctctggaggtcctcgtggcagacctggtgaacgctcagaaagatagcatgcaggatgagagctcacaaacttcactgcaaaaggagatttcgaccgaagagcaacttcggagactgcaggaagagaagctgtgcaaaatctgcatggatcgaaacatcgccatagtctttgtgccttgcggtcatctggtgacctgtaagcaatgtgcagaagcagtggataagtgtcctatgtgctacacggtcattacgtttaagcagaaaatcttcatgtcg

SEQ ID NO: 33833 - DNA, 1491 bp, Artificial Sequence
  Description of Artificial Sequence: Synthetic coding sequence
atgactttcaacagcttcgagggatcgaaaacgtgtgtccctgccgatatcaataaggaagaagagtttgtcgaagaattcaatcgcctcaagacctttgctaatttcccatcgggaagcccggtgagcgcctccaccctcgcgcgcgctgggttcctctacaccggtgaaggagacacggtgcgatgcttcagctgccatgcggccgtggataggtggcagtacggagattccgcagtcgggcggcatcggaaggtgagcccgaactgcaggttcatcaatggtttttacctggagaactcagctacccagagtactaactcgggaatccagaatggacagtacaaggtggagaactaccttggaagtcgggaccacttcgccctcgatcgcccctcggaaacccacgccgattaccttctgcggacgggacaagtggttgatatctcagacacgatctacccacgcaacccggcgatgtactcagaagaagcacggctgaagtctttccaaaattggccagactacgcgcacctgaccccccgcgaactcgcgtctgccggactgtactataccggtatcggagatcaggtgcagtgcttctgctgcggaggtaagctgaagaactgggaaccatgcgaccgcgcctggtccgagcacaggcggcatttccccaattgcttcttcgtcctgggtagaaacctcaatattcggagcgagtcagatgcggtgtccagcgacaggaacttcccaaactcaactaacctcccgcggaatccttccatggccgactacgaagccagaatcttcaccttcggcacgtggatctattcagtgaacaaagagcaactcgctagggcaggcttttatgccctgggagaaggagacaaggtgaaatgcttccactgcggcgggggcctcaccgactggaaaccttcggaagatccgtgggaacaacacgcaaagtggtaccctggatgcaaatacctgctggagcaaaagggacaggaatacatcaataacatacacctcactcattctcttgaagagtgtctcgttcgcaccacggaaaaaaccccatccttgactcgcaggattgacgacactattttccaaaatccgatggtgcaggaagccatccgaatgggattctccttcaaggacatcaaaaagatcatggaagagaaaatccaaatctcaggatcgaactacaagtcgctcgaggtgctggtggccgatctggtcaatgcgcaaaaggactcaatgcaggacgaatcgtcgcaaacctccctccagaaagagatcagtactgaagagcaattgcggagactccaggaagagaagctctgcaagatttgcatggatcgcaacatcgccatcgtgtttgtgccttgtggccatctcgtgacttgcaagcagtgtgccgaggcggtggacaagtgccctatgtgctacactgtgatcacctttaaacagaagattttcatgtct

SEQ ID NO: 33834 - DNA, 1491 bp, Artificial Sequence
  Description of Artificial Sequence: Synthetic coding sequence
atgactttcaattctttcgaagggtctaaaacttgcgtaccagcagacatcaacaaggaggaagagttcgttgaggagtttaaccggctcaaaactttcgcaaacttcccgagcggatctccagtgtcggcatcaacgcttgcgcgggccggattcttgtatactggcgagggagatactgttagatgtttttcctgtcacgccgcggttgatcggtggcagtacggcgacagtgcagtcggcaggcacaggaaagtctcgcctaattgccgattcattaatggattctacctggagaactcagcaacacagtctactaattcagggatccagaatggacagtataaggttgagaattacctgggtagtagagatcattttgcgctggatcggcccagcgagactcatgccgattacctgttgcgtactggccaagtcgtggacatcagtgacaccatctatccaaggaatccggctatgtactcggaagaagcccgccttaaatcgttccaaaattggcccgactacgctcatctgacaccaagggaacttgcttccgctggcttgtactatacgggtattggagatcaagtgcagtgcttctgctgcggcggcaagcttaaaaactgggaaccatgtgatcgagcctggtccgaacacagacgccacttccctaactgtttttttgtattaggcagaaatcttaacattaggtcagagagcgacgccgtctcatccgataggaactttcccaacagcaccaacctgccacgcaacccaagtatggccgattatgaggctcgaatcttcacgttcgggacttggatatacagcgtgaataaagagcaactcgctcgggccgggttttacgcccttggagagggggataaggtcaagtgctttcactgtggaggaggcctcactgattggaaaccctcggaggatccatgggagcaacacgcaaagtggtatccaggatgtaagtacttgctcgagcagaaaggtcaggagtacattaacaacatacacctgacccattcccttgaagagtgcctggtcagaactactgaaaaaacaccgtctctgacccgacgaattgatgataccatttttcagaacccgatggtccaggaagctatccgaatggggttctcattcaaagacatcaagaagattatggaagagaaaatccagatctccgggagcaactataaaagcctggaagtgctggtcgctgacctcgtcaacgcacaaaaagattcaatgcaggacgaatcctcgcagacaagtttgcagaaagaaatctcgaccgaagagcagctgagacgactgcaggaggaaaagttatgcaagatttgtatggaccggaacatcgctattgtgttcgtgccttgtggccacttggtgacttgcaagcagtgtgccgaggcagttgataaatgtccaatgtgctacaccgtcattacgttcaagcagaaaattttcatgtcc

SEQ ID NO: 33835 - DNA, 1491 bp, Artificial Sequence
  Description of Artificial Sequence: Synthetic coding sequence
atgaccttcaatagcttcgagggttcaaagacttgcgttccagccgatatcaacaaggaagaagagttcgtggaagagttcaaccggctcaagacgttcgccaatttcccttccggatccccggtgtcagcttcaaccctggctcgggccgggttcctttatacgggcgaaggcgataccgtgaggtgcttctcctgccatgcggcagtcgatcggtggcagtacggagattcagcagtggggaggcatcgcaaggtgtcgccgaattgcaggtttatcaacggattctacttggaaaacagcgcaactcaatcgaccaactcggggattcagaacggccagtacaaggtggaaaactacttgggctcccgggaccatttcgccctggacaggccttccgaaacgcacgccgattatcttctgcgcaccggccaagtggtggacatttcagacactatctatccgagaaatcctgctatgtactcagaggaggctagactcaaatcatttcagaactggcctgactacgcgcatctcaccccgagagagctggcgtcagccgggctctactacactgggattggagatcaagtgcagtgtttctgctgtgggggaaagctgaagaattgggagccttgcgacagggcatggtcagagcaccgcagacattttccaaactgtttcttcgtgctcggccgaaatctgaacatcaggagcgaatcggacgctgtgtcgagcgatagaaatttcccaaactcgactaatctgccacggaacccatcaatggcggattacgaagcccggattttcaccttcggaacctggatttactcggtgaacaaagaacagctggcccgggccggcttctacgctctgggagagggagacaaggtcaagtgctttcactgcgggggaggtctgaccgattggaagccgtccgaagatccgtgggaacaacacgccaaatggtacccaggctgcaagtacctcctggaacagaagggccaagagtacatcaacaacatccacctgacccactccctggaagagtgccttgtcagaaccaccgagaaaaccccctccctgacccgccgcattgatgacaccatcttccagaacccgatggtgcaggaggccatccgcatgggattctccttcaaagacatcaagaagatcatggaagagaagattcagatatccggttccaactacaaatccctggaggtcctggtggcagacctcgtcaacgcgcaaaaggatagcatgcaggacgagtcgtcccagacctctctccagaaagagatttccaccgaagagcagctgcggcgcctgcaagaggaaaagctgtgcaagatctgcatggaccgcaatatcgcaatcgtctttgtgccttgcgggcatttggtgacttgcaagcagtgcgccgaagcggtggacaaatgcccgatgtgttataccgtgatcacctttaagcaaaagatattcatgagc

SEQ ID NO: 33836 - DNA, 1491 bp, Artificial Sequence
  Description of Artificial Sequence: Synthetic coding sequence
atgactttcaatagtttcgaaggatcaaagacctgcgtcccagccgatatcaataaggaagaggaattcgttgaggagttcaaccgcctcaagactttcgcaaacttcccttccggatcccctgtctcggcttcgaccctggctagagccggcttcctgtataccggagagggcgacactgtgagatgcttctcgtgccatgccgcagtggaccggtggcagtatggtgattcagctgtcggtagacacagaaaagtgtcaccgaactgccgcttcatcaacggcttctacctcgagaattcggctactcagtcgactaattccgggatccaaaacggacagtacaaagtggagaattacttggggtccagggaccacttcgcgctggaccggccaagcgagactcacgcagactacctgctgcgcaccggacaggtggtggatatcagcgacaccatctaccctcgaaacccggcgatgtacagcgaagaggcccgcctgaagtccttccagaactggccggactacgcgcaccttactccgcgcgagctggcttccgcgggactgtactacactgggatcggggatcaagtgcagtgcttctgctgtggcggaaagctgaaaaactgggaaccatgcgaccgggcctggtcggagcatcgccgccacttccccaattgttttttcgtgctcggacgcaatttgaacatcagaagcgaatcggacgcagtgtccagcgataggaacttccctaacagcaccaacctccctcgcaaccccagcatggcagactacgaagcccgcatctttactttcggaacctggatctactcggtcaataaggagcagctcgcgagggccggattctacgctctgggagaaggcgacaaggtcaagtgctttcattgcggtggcgggctcacggattggaaaccgtcagaggacccgtgggagcagcacgccaagtggtacccgggctgcaaatacctcctggaacagaagggccaggaatacattaacaatatccacctgactcactcactcgaagaatgtctcgtgcggacgaccgagaaaacccccagcttgactcgccgcattgacgacactatctttcagaacccaatggtccaagaggcgatccgcatgggattctcctttaaagacatcaagaagattatggaagaaaagatccagatctcgggatcgaactacaagagcttggaggtgctcgtggcagatcttgtcaatgcacagaaggactctatgcaagatgagtcatcgcagacgtcgctccagaaggaaatttccactgaagaacaactccggagacttcaagaggaaaaactgtgcaagatctgtatggacagaaatatcgcgatcgttttcgtgccgtgtggacatttggtgacttgtaagcaatgcgccgaggccgtcgataagtgtccgatgtgctacacggtcatcacttttaagcaaaagatctttatgtcc

SEQ ID NO: 33837 - DNA, 1491 bp, Artificial Sequence
  Description of Artificial Sequence: Synthetic coding sequence
atgaccttcaactcatttgaaggatccaagacctgcgtgccggcggatattaataaagaggaggagtttgtcgaagaatttaaccgcctgaaaacgttcgcaaatttcccgtcagggtcgccagtgtcagccagcaccctcgccagggccgggtttctgtacacgggcgagggagatactgtgcgctgcttttcctgtcatgccgccgtggaccgctggcagtacggcgactcggccgtcgggcgccaccgcaaggtgtcgccgaactgcagatttatcaatggtttctacctcgagaacagcgctacccagtcaaccaactctggaatccagaacggccagtacaaggtggaaaattacctcggttcgcgcgaccacttcgctctggaccgccctagtgaaactcatgctgactaccttctgcgcactggccaggtggtcgatatctccgacactatctacccacgcaacccggctatgtacagcgaagaggcaaggctgaaatctttccagaactggccggactacgctcatctcaccccacgggaactcgcgtccgccgggctgtactacaccggaatcggcgaccaggtgcaatgcttctgttgtggtggcaagttgaagaattgggaaccgtgcgacagagcgtggtcggaacaccggcggcatttcccgaattgcttcttcgtgctgggaagaaacttgaatatccggagcgagtcagacgccgtctcgtcggaccgcaacttcccgaactcaactaacctgccccggaacccctcgatggccgattacgaggcacgtatcttcactttcggaacgtggatctactcggtgaataaggagcagctggcgcgagcgggattctacgccctgggtgaaggagacaaagtcaagtgtttccattgcggaggagggcttaccgactggaagcctagcgaggatccctgggagcaacacgcaaagtggtacccaggctgcaagtatctcctggaacagaagggacaggaatatatcaataacatccacctgactcactccttggaggagtgcttggttcggaccaccgaaaagaccccatccctcactcggagaattgatgataccatttttcagaaccctatggtgcaagaagcgatccggatgggattctcattcaaagacatcaagaagatcatggaagaaaaaattcaaatctccggatccaactacaagtccctggaagtgctggtggcagatctcgtcaatgcccaaaaggactcgatgcaggatgaaagctcgcagacttcccttcaaaaagaaatcagcaccgaagagcaactgaggagactgcaagaggagaaactttgtaaaatatgcatggatagaaacatcgccatcgtgttcgttccttgcggacacctcgtcacttgcaagcagtgcgcggaggcagtcgacaagtgtccgatgtgctacactgtgatcacctttaagcagaagattttcatgagc

SEQ ID NO: 33838 - DNA, 1491 bp, Artificial Sequence
  Description of Artificial Sequence: Synthetic coding sequence
atgactttcaactcgtttgaggggtctaagacctgtgtgccggccgacatcaacaaggaggaggaattcgtggaggaattcaataggctcaaaacttttgccaacttcccatcgggatcaccagtctccgcctcaaccctggcccgggccggtttcttgtacaccggcgagggagataccgtccggtgcttcagctgccacgctgccgtggatcgctggcagtacggagattcggctgtgggacgccatcgaaaggtgtcaccgaattgccgcttcataaatggattttaccttgagaactccgcgacccaatcaactaattcaggcatccagaacggacaatacaaagtggagaattatctgggatcaagggaccacttcgcgctcgaccgcccctccgagactcatgcagattacttgctgagaaccggccaggtcgtggacatctcagacaccatttacccacggaacccggcaatgtacagcgaggaggccaggctcaagtcattccaaaattggcctgattatgcccacctcacccctcgcgaactggccagcgctggactctactacaccggaattggggaccaggtgcaatgcttctgctgtggagggaaactgaaaaactgggaaccttgcgatcgcgcatggtcggaacaccggcggcatttccctaactgcttcttcgttttgggacgcaacctgaacatacggagcgagtccgatgcagtctcctccgaccggaatttcccgaacagcactaaccttccaagaaaccccagcatggccgactacgaagctcgcattttcaccttcggaacttggatctacagcgtcaataaggagcagctggcccgagcaggattctacgcgctgggggagggagacaaagtcaaatgttttcattgcggaggggggctgaccgattggaagccgtcggaagatccttgggaacaacacgcgaaatggtacccgggttgcaagtacctgctggaacaaaaaggacaggagtacatcaacaatatccaccttacccatagcctggaggaatgcctcgtgaggaccactgaaaaaactccaagccttactcggcgtattgatgatactatctttcagaacccgatggtccaagaagcgatccggatggggttcagctttaaagacatcaaaaagatcatggaagagaagattcagatttcgggatcaaactacaagtccctggaggtgctcgtggctgatttggtgaacgcccagaaggacagcatgcaggacgaatcatcgcagacctccctgcagaaggagatcagcaccgaagaacagctgcggcggctgcaagaggagaagctgtgcaaaatctgtatggaccggaacatcgcgatcgtgtttgtgccgtgcggacacctcgttacttgcaagcagtgtgcggaagccgtggataagtgtccaatgtgctacaccgtgatcacctttaagcagaagatctttatgagc

SEQ ID NO: 33839 - DNA, 1491 bp, Artificial Sequence
  Description of Artificial Sequence: Synthetic coding sequence
atgactttcaactccttcgagggttcaaagacttgcgtgccggcggatatcaacaaggaggaggagttcgttgaggagtttaaccgtctcaagaccttcgcgaactttcctagtggttcacctgtctccgcctctaccctagctcgtgctgggttcctgtatacgggagagggtgacaccgtgagatgcttcagctgccacgcggcggtagaccgttggcaatacggagactcagctgtcggccgtcacaggaaggtttcccctaattgccgtttcattaacggtttctatttggaaaacagtgcgacccagtccacaaattcaggcatccagaacggtcagtataaggtagagaattatctggggtcccgcgatcatttcgctctggaccggcctagcgagacccacgccgactacttgctccgcaccggtcaagttgttgacatcagcgatacgatctacccacgtaaccccgctatgtattcggaggaggcacgtttgaagtccttccagaactggcccgattacgctcaccttactccccgcgagctggcttcggcgggattatattacaccggcatcggtgatcaggtacagtgcttctgctgcgggggcaagctgaaaaattgggaaccctgcgatcgagcgtggtcagaacaccggagacacttccccaactgtttcttcgtcctgggcagaaatttgaacatccgcagtgagtccgacgccgtctcctccgaccgtaacttcccgaactctaccaacctccctcgaaatccgtccatggctgactacgaggccaggattttcaccttcggaacctggatctactccgtcaacaaggagcagctggccagggctggtttttatgccctgggagaaggggacaaggtgaagtgctttcactgcggcggcggactgaccgactggaagcctagcgaggatccttgggagcaacacgcgaaatggtacccgggttgcaagtatctcttggagcaaaagggacaggagtatatcaataatatccacctgacccacagcctggaggagtgcctggtccgcactaccgagaagaccccgtctttgactcgccggatcgatgacaccattttccagaaccctatggtccaggaggccatccggatgggcttcagtttcaaggacattaagaagatcatggaggagaagattcagatctccggctcgaactacaagtcccttgaggtgctggtagccgacctcgtgaacgcacagaaagactcgatgcaggacgagtcctcccaaacgtctttgcagaaggagatcagcaccgaggagcagctccgccgtctgcaggaggagaagctctgcaagatctgcatggacagaaatattgccatcgttttcgtcccctgtgggcatctggtgacctgtaaacagtgcgcggaggccgtggataagtgtcccatgtgctacacggtcatcaccttcaagcagaagatcttcatgagc

SEQ ID NO: 33840 - DNA, 1491 bp, Artificial Sequence
  Description of Artificial Sequence: Synthetic coding sequence
atgacctttaacagttttgaaggtagcaagacttgcgtgcccgcagacattaacaaagaggaagaatttgtggaggaattcaatcgcctcaagactttcgcaaacttcccctcgggtagcccagtgtccgcgtcaaccctggctcgggccgggttcctttacaccggtgagggcgacactgtgagatgctttagctgccatgctgctgtcgataggtggcagtacggagatagcgcagtggggagacacagaaaagtctcacccaattgtcggttcattaacgggttttatctggaaaactccgcaacccagtcaaccaactcgggcatccagaatggccagtacaaggtcgagaactacctgggctcccgcgatcatttcgcactcgatcgtccatcggaaacccatgcagattacctgcttagaactggacaagtggtggatatttcggataccatatacccaaggaatccggcgatgtattccgaagaggcgaggttgaaaagtttccaaaactggccagactacgcccatctgacccctcgcgaactggcctcagccgggctttactacaccggaatcggagatcaggtgcagtgcttttgctgtggaggtaaactgaaaaactgggagccttgtgatagggcatggtccgaacatagacgccatttcccaaattgttttttcgtccttggacgtaaccttaacattcgctccgaatccgatgccgtgtcatcagacaggaattttcccaactccaccaacctgccaagaaacccctcgatggcagattacgaagcccggatcttcactttcggaacctggatttactcggtgaacaaggaacaactggcacgagccggcttctacgcattgggagaaggtgacaaagtgaagtgttttcattgtgggggaggtctgactgactggaagccctcagaggacccatgggaacagcatgctaagtggtacccggggtgcaaatacctgctcgaacaaaagggacaagaatacattaacaacatccaccttacccactctctcgaagagtgtctggtccgcactacggaaaaaacgcctagcctcactcgtagaatcgatgacaccatttttcaaaatccgatggtccaggaagcgattcgcatgggtttttcgtttaaagacattaagaaaatcatggaggaaaagattcaaatttccggatcgaactacaagtcgctggaggtcctggtcgcagacctggtgaatgcacaaaaggattccatgcaagatgaaagctcgcaaacctcgctgcaaaaggaaatttcgaccgaggagcaactgcgccggctccaggaagaaaagttgtgtaagatctgcatggatcgcaacatcgcaattgtgttcgtgccatgtggtcacctggtgacctgtaagcagtgtgcagaagccgtcgacaaatgtcctatgtgttacaccgtgataacttttaagcagaagatattcatgtca

SEQ ID NO: 33841 - DNA, 1491 bp, Artificial Sequence
  Description of Artificial Sequence: Synthetic coding sequence
atgacatttaactctttcgagggctctaagacctgtgttccagctgatatcaacaaggaagaggaatttgtggaggagtttaaccgactgaaaactttcgctaatttccccagtggctcccctgtctcagcgtcaacactcgctcgagcagggttcctctatactggcgagggggacacagtgcgatgtttcagctgccacgctgctgtggatcgctggcagtacggtgactctgccgttggccgtcatcggaaggtgtcgcctaactgccggttcatcaacggattttacctagagaattctgctactcagagcactaattccggtatccagaatggacagtacaaagtggaaaattacctgggctccagggatcactttgccctggaccgtccatccgagacccacgcagattatctgcttaggacaggtcaagtcgttgatatttcagatacaatctatccccgcaaccctgcgatgtactctgaggaagcgcgcctcaaaagtttccaaaattggcctgattacgcacatcttacccctagggaacttgcgtccgcaggcctgtattatacaggcatcggtgaccaggtccagtgtttctgttgtggcgggaagctaaaaaattgggagccctgtgacagggcctggagcgaacatcgcagacatttcccgaattgtttcttcgtactcggcagaaatcttaacatcagatccgagtctgatgccgtgtcaagtgacagaaatttcccgaatagtaccaatttgccccgcaatccatctatggccgattacgaagctaggatttttacttttggcacctggatatattcagtgaataaggaacagctcgctagggcagggttttacgcacttggggagggcgacaaagtcaaatgttttcactgcggaggaggactcaccgactggaagccatccgaggatccatgggaacagcatgctaaatggtatcccggctgtaaatatttactagaacaaaaaggacaagaatatattaacaatattcacctaacacactctctcgaagaatgcctggtccgcactactgagaaaacccccagcctcacacgtcgcattgacgatactatcttccagaatcctatggtccaagaagccattcgcatgggattttcctttaaggatatcaaaaagatcatggaggaaaaaatccaaatcagtgggagcaactataagtccctggaagttttggttgccgacctagtcaatgcacagaaagattccatgcaagatgagtcttcccagacctcactccagaaggagattagcactgaggaacagttgcgtcggcttcaagaagaaaagctttgtaaaatatgcatggaccgtaacatagctattgtgttcgtcccttgcggacacctggttacttgtaagcaatgcgcggaggctgtcgacaagtgtcctatgtgttacacggtgattactttcaagcaaaagatcttcatgtct

SEQ ID NO: 33842 - DNA, 1491 bp, Artificial Sequence
  Description of Artificial Sequence: Synthetic coding sequence
atgacctttaacagcttcgagggcagcaagacgtgtgtgccagcggacataaacaaagaggaagagtttgtggaagaattcaatagacttaagacctttgcaaatttcccatccggatcgccggtgtcagcatccacccttgccagggcaggattcctctacacgggggaaggagataccgtgagatgtttttcctgccacgccgcagtggacagatggcagtacggtgattccgccgtcggaaggcatagaaaggtgtcccccaactgtcgcttcataaatggattctatcttgaaaattccgccacgcaatcaactaactcgggaatacaaaacgggcagtacaaggtggaaaactacctcggatcacgcgatcacttcgcgcttgatagaccatccgaaacgcatgccgactacttgcttcgaaccggccaagtggtggacatttcagacacgatttacccccgcaaccctgcaatgtactccgaagaagcgagactcaaatcctttcagaattggccagattacgcacatctcactccccgagaactcgcgtcggcaggtctgtattacactggaatcggtgatcaggtgcaatgcttctgttgtggggggaagctcaagaattgggagccatgcgatcgtgcatggtcagagcatcggagacacttccccaactgcttttttgtcctgggtagaaacctgaacattagatcagagtcggacgcagtctcctcagacaggaattttccgaactctaccaacctccctcggaatccttcgatggcagattacgaagcgcggatctttacctttggcacgtggatttactcagttaacaaggaacaactcgcccgcgcaggcttctatgcccttggagaaggtgataaagtgaaatgcttccattgtggcggcggcctgaccgattggaagccttcggaggacccttgggagcaacacgctaagtggtaccctggatgtaagtacctcctcgagcagaagggtcaggaatacatcaataacatccatctgacccatagccttgaagagtgtcttgtgagaaccactgaaaagactccttcacttactagaaggattgatgataccatctttcaaaacccgatggtccaagaggcgatcagaatgggattctccttcaaggacattaagaaaatcatggaagagaaaatccaaatatccggctcgaattacaagtcgcttgaagtgttggtcgcagatctggtcaacgctcagaaagatagcatgcaggacgaatcaagccaaacttctctgcaaaaagagatctcaaccgaggaacaactgcgcaggctgcaagaagaaaagttgtgcaagatttgtatggatcggaacattgcaattgtgtttgtgccttgtggacatctggtcacttgcaagcaatgtgcggaagcagtggacaagtgtcctatgtgttacaccgtgattaccttcaaacagaagattttcatgtcc

SEQ ID NO: 33843 - DNA, 1491 bp, Artificial Sequence
  Description of Artificial Sequence: Synthetic coding sequence
atgacattcaactcctttgagggctccaagacatgtgtcccagctgatattaacaaagaggaagaattcgtcgaagaattcaaccgcttgaagactttcgcaaattttccgtctggatctcctgtgagtgcaagtacactggcacgagcaggcttcctctatactggagagggcgacacagtgcgttgtttctcttgtcacgccgctgtggatagatggcagtatggcgattcggcagtgggccgccacaggaaggtttctcccaactgcaggttcataaatggtttttacttagaaaattcagccacccaatcaactaacagcggaatccagaatggtcagtataaggtggaaaattacctcgggtctagagatcacttcgcactggacagaccctctgaaacccacgctgactacctgctgcgcacaggccaggttgtcgacatcagtgataccatttatccacgaaatcccgccatgtacagcgaggaggctaggttgaagtccttccagaactggcctgattacgcccacttaactcccagagagctggcgagcgctggcctctactacacagggatcggagaccaggtgcaatgtttctgttgtggcggaaagttgaaaaattgggagccatgtgaccgggcctggagtgagcaccggagacatttcccgaactgtttctttgtactgggtcgaaacctgaacattcgctctgaaagcgacgcggtttcatcagatagaaacttccctaattccactaatttgcctagaaacccttcaatggccgactacgaagcaagaatctttacctttggcacatggatctattcagtgaataaagagcagctggcccgcgccggcttttatgctctgggcgaaggggacaaggtaaagtgttttcattgtggtgggggcctgactgattggaagccatcagaagacccctgggaacaacatgcgaaatggtaccctggctgcaaatacttattggaacaaaagggccaagagtatattaacaacatccacctgacccacagtctggaagaatgtctggtgcgcacgacagagaaaactccatctctcacacgacggatagatgatacgatcttccaaaatcctatggtccaggaggccatcaggatgggtttttcctttaaggatataaaaaaaataatggaagagaagatccagatctcaggtagtaattataaatcacttgaggtgcttgttgctgacttagtgaacgcacagaaggactcaatgcaggatgagagctcccagacaagtcttcagaaggagatatctactgaggagcagcttcgccgtctacaggaagaaaaactgtgcaagatctgtatggaccgcaatatagctatcgtgttcgtgccgtgtggccacctggtcacctgtaagcagtgtgccgaggcggtcgataagtgccccatgtgttacactgtcattacttttaagcagaagatcttcatgtcc

SEQ ID NO: 33844 - DNA, 1491 bp, Artificial Sequence
  Description of Artificial Sequence: Synthetic coding sequence
atgacgttcaattctttcgaaggaagtaaaacctgcgtgcccgcagacattaacaaagaggaagaatttgtagaggaatttaatcggttaaagacatttgcaaattttccttccgggtcccctgtatccgcaagtactttggcgcgagccggcttcctgtacaccggggagggggacactgtgcggtgcttctcttgccacgctgcagtggacaggtggcagtatggcgatagcgcggttggccgacaccgaaaagtgagccctaattgccgcttcattaatgggttttatttggaaaatagcgccacccagtcaaccaatagcggtatccaaaacggccagtacaaggtggagaactacctgggatctagggaccattttgccctggaccgacccagcgagacacatgctgattatttactgaggactggccaggttgtggatattagtgatacaatctaccctcggaaccccgcgatgtacagcgaggaggcacggctgaagagttttcagaactggccggactacgcccatctaacaccccgcgaactggcgagcgccgggttatactacacaggtataggcgatcaagtccagtgcttctgctgtgggggaaaactgaagaattgggaaccttgtgaccgagcatggtctgagcacaggagacatttccctaattgcttttttgtgctgggacggaatctcaatatcagatctgagagtgatgccgtgtccagcgaccgtaacttcccaaactctacgaacttacctcgtaatccgtcgatggctgactatgaggctcgaatttttactttcggtacctggatatacagtgtgaacaaggagcaattagctcgggctggattttacgcactgggagaaggcgacaaagtgaagtgcttccattgtggcgggggcttgaccgattggaagccgagtgaggacccatgggaacagcatgcaaaatggtacccaggctgtaagtacctgctcgagcaaaagggccaggagtacattaataatatccacctgacacattcactggaagagtgtttagtgcgtacgaccgaaaagacaccgtctctgactcgacgaattgacgataccatattccagaaccccatggtacaggaggcaattcgtatgggcttctcctttaaggatattaaaaagattatggaagagaaaatacagatatccggatccaactacaagtcgctggaggtcttggtcgcagatttagtgaacgcccaaaaggatagtatgcaggatgagagttcacagacttcactgcagaaagagatatccaccgaggagcagctgagaaggctgcaggaggagaaactgtgcaaaatctgtatggatcgcaacatcgctatcgtgtttgtgccctgcggacacctggttacctgcaaacagtgcgcagaggcagtagacaagtgccccatgtgttacactgttatcacctttaaacagaagattttcatgagc

SEQ ID NO: 33845 - DNA, 1491 bp, Artificial Sequence
  Description of Artificial Sequence: Synthetic coding sequence
atgacattcaacagttttgagggttcaaagacttgtgttcccgccgacatcaacaaggaggaggaatttgtggaagaatttaatcgcctaaaaacatttgcaaattttccatctgggtcgccagtgtctgcttccacccttgccagagcaggttttctgtacacgggggagggtgacactgtacggtgcttttcgtgccacgcggccgtggatcggtggcagtatggtgatagcgccgttgggcggcaccgaaaggtgtcgcctaattgcagatttataaacggcttctatcttgagaacagtgcaactcagtccactaattccgggatccagaatggccagtataaggtggagaactacctcggtagtcgggatcatttcgcactggaccgtccgagtgagacccatgccgactacttgctgcgaaccggccaagttgtggacatctctgacactatctacccacgcaatccggccatgtatagtgaggaagccagacttaaaagctttcagaattggccggactacgctcatctgactcccagggaactcgcctccgctggattgtattacacgggcatcggtgaccaggttcaatgcttctgctgtggcgggaaattaaagaattgggaaccttgcgacagagcgtggtctgagcatcgacgtcacttcccgaactgtttttttgtgctgggaaggaatttgaacatacgctccgaatcagacgctgtgtcgtcagatagaaatttcccaaacagtaccaatctgccgaggaacccgtctatggctgactacgaagcccggatctttacattcgggacctggatctacagcgtgaataaagagcagctggcgcgggccggcttttacgcacttggagagggtgataaggtaaagtgctttcattgtgggggagggctgaccgactggaaacctagtgaagatccatgggagcagcacgccaagtggtacccaggatgcaagtatctgctcgaacaaaaggggcaggagtacattaacaacatacacctgacacacagcttagaggagtgtctggtgcggaccactgagaaaacaccaagcttaacacggcgcattgatgacactatctttcaaaaccccatggtgcaggaggctatccgaatgggcttttcattcaaggacataaagaagataatggaggagaagatacagattagtggctctaactataagagccttgaggtcctggtggcagatctcgtgaatgcccagaaggacagtatgcaagacgaaagctcccagacgagcctccagaaggagatatccacagaggagcagctgcggcgccttcaggaggaaaagctctgcaaaatatgtatggatcgaaatattgctatcgtgtttgtgccttgtggacacctagtgacctgcaagcagtgcgctgaagccgtcgataaatgccctatgtgctacaccgtgataacttttaagcagaagatcttcatgagt

SEQ ID NO: 33846 - DNA, 1491 bp, Artificial Sequence
  Description of Artificial Sequence: Synthetic coding sequence
atgaccttcaacagctttgaagggtctaagacatgcgtgcctgccgatatcaataaggaggaggaatttgtggaggagttcaacaggctgaagaccttcgcgaacttccccagcggatctccggtctctgcatccaccttggcccgagccggttttctgtatacaggagaaggcgacactgtccggtgcttcagctgccatgcggccgtggacaggtggcagtacggcgacagcgctgtaggccggcacagaaaggtttctcccaactgtcgattcattaatggattttatctggagaactctgcaacgcagagcacaaactctggcatccaaaacggccagtataaagtggaaaattatctcggcagtagggatcacttcgccctcgatagaccgtccgagacacacgccgactacctgctgaggactggtcaggttgtcgatatctcagataccatttatcctcgcaatcccgccatgtactccgaagaggcccgcctcaaaagctttcagaattggcccgattatgcccatcttactcctcgggagctcgcatcagcagggctgtattacaccggaatcggcgaccaggttcagtgtttttgctgtggcgggaaattgaagaattgggagccttgtgacagagcttggtccgaacatagacgccattttccaaattgtttcttcgtgctgggccggaatctgaacattcggtcagagtcagacgcagtgagctccgaccgcaacttccctaacagtaccaatctgcccaggaacccctccatggccgattacgaggcacgaatatttacctttgggacctggatctactccgtgaataaagagcaactcgctagagccggattctacgcccttggggagggcgacaaggttaagtgcttccactgcggcggagggttgacagattggaaaccctcagaagacccgtgggaacaacacgcgaagtggtacccgggatgtaaatatctcctggagcagaaaggacaagaatacataaacaatatccatctgacccatagcctggaggagtgtttggttagaaccactgaaaaaactccttccctgactcggcgcatagatgataccatcttccagaatcctatggtgcaggaggccatacggatgggcttctcttttaaagatatcaagaagatcatggaagaaaagattcagattagcgggtccaactacaaatctctggaagtgctcgtggccgacctggtcaatgcccaaaaggactcaatgcaagacgagtcttcacagacttccctccaaaaggaaattagcaccgaggagcagctgagaagacttcaggaggagaaactttgcaagatctgcatggaccgcaacattgcgatcgtgttcgtcccttgcggacacctggtgacctgcaagcagtgtgccgaggcagtagataagtgcccaatgtgttacaccgtgatcacgttcaagcagaaaatctttatgagt

SEQ ID NO: 33847 - DNA, 1491 bp, Artificial Sequence
  Description of Artificial Sequence: Synthetic coding sequence
atgaccttcaactcctttgaagggagtaagacttgcgtcccggcagatattaacaaagaagaagaatttgtagaggaatttaaccggctgaaaactttcgccaatttcccatctggaagtcccgtctctgcctcaaccttggcccgagccggctttctctatacaggagaaggtgatacggtgcgttgctttagctgccatgccgctgtcgatcggtggcaatatggcgatagcgcggtcggacgtcacaggaaagtttcaccgaattgtcggtttattaatggtttttatctcgagaattcagcgacacagtcaacaaattcgggaatccagaacgggcaatacaaagtcgaaaattatcttggaagccgcgatcactttgctcttgatagaccaagcgaaacccacgctgattaccttttacgtacgggtcaagtggtagatatctcagacacaatttatcctcgcaatcctgcaatgtattctgaggaagcaagattaaaatcctttcaaaattggcctgattatgcccaccttacaccgcgagagctggcgtctgcggggctctattacacgggaattggggatcaggttcagtgtttttgttgtggcgggaaattgaaaaactgggagccatgcgatagagcatggagtgaacaccgtagacatttccctaactgtttttttgtattaggacgtaacttgaacatccgcagtgaaagcgacgctgtctcatcagaccgtaactttcctaattcaactaatctcccgcggaatcccagcatggctgattacgaggcacgcattttcactttcgggacatggatatattctgtaaataaagaacagttagctagggccggattttatgctttgggagaaggagacaaagtgaagtgttttcactgcggcggggggctgacagattggaaaccatcagaagacccttgggaacaacacgctaaatggtatcccggctgtaagtacctgttagagcagaaaggacaagagtatattaataatattcatttaactcactctctggaagagtgcctggtacggacaaccgaaaaaactccttccctcacgaggaggattgatgatacgatcttccagaacccgatggtgcaggaagcgatccgtatgggattctcgttcaaagatatcaaaaaaattatggaggagaaaattcaaattagtgggtccaattacaagtctctagaggtattggtggccgatctagttaatgcccaaaaagatagtatgcaagatgaaagcagccaaactagcttacagaaagaaatttccacagaagaacagcttagaagactacaagaagaaaagttgtgcaaaatatgcatggatcggaatatcgctattgtatttgtcccgtgtgggcatctggttacatgcaaacaatgcgcagaggccgtcgataagtgccctatgtgctatacggtgattacttttaaacaaaaaatctttatgtcc

SEQ ID NO: 33848 - DNA, 1491 bp, Artificial Sequence
  Description of Artificial Sequence: Synthetic coding sequence
atgacctttaattcctttgagggttctaagacatgcgtgcccgcagacattaacaaggaagaggaattcgtagaggaattcaataggctgaaaacgtttgcaaatttcccctcagggtcgcccgtgtctgcatccaccctcgcacgcgccggcttcttgtacactggcgagggggatactgtaagatgtttctcatgtcacgctgccgtcgaccgctggcagtacggtgactccgctgtaggtcggcaccggaaggtaagccctaattgtcggttcatcaatggcttttacctggagaatagcgctacacagtcaaccaattcaggtattcaaaatgggcaatataaggttgaaaattacctggggtccagagaccactttgccttagatagaccaagcgaaacacacgctgattacctactgcgtaccggccaggttgtggatatctctgatacaatatacccaaggaatccggctatgtattccgaggaagcaaggctgaagtcattccaaaactggcctgattacgcccacctcacacctcgcgaacttgcttccgcaggactatactatacaggcatcggagatcaggtccagtgcttctgttgtggcggaaaactaaaaaattgggagccatgtgatcgagcctggtcagaacatcggcgtcactttcctaattgctttttcgtgttgggcaggaatctcaatataagatcagaaagcgatgctgtttcttccgatagaaatttcccaaactctacgaacctgccgaggaatccttctatggcagactacgaggcccggatttttacatttggaacttggatttacagtgtaaataaagagcagttggcccgggcgggattttatgccctgggtgaaggagacaaggtaaaatgtttccattgcggaggtggtctgactgactggaaacctagcgaggatccgtgggagcagcatgcgaagtggtatccggggtgcaagtacctgctcgagcagaaaggccaggaatatattaacaacatccatctaactcactcattagaagaatgtctggtgaggaccacagaaaagacaccatcattgacacgtcggatagatgacacaatcttccagaatccaatggttcaggaggctatcaggatgggcttttcctttaaagatatcaagaaaatcatggaagagaagatacaaatttcgggaagcaactataaatctcttgaggtcctagtggcagatctagtcaacgctcagaaggattccatgcaggacgagtcttctcagacatctctccagaaggagataagcactgaggagcagttgcggaggttgcaggaggagaagctgtgcaagatctgcatggatagaaacattgccatcgttttcgtgccatgcggtcatctagttacttgtaaacagtgcgctgaggccgtcgacaaatgccccatgtgctacaccgttattacctttaaacaaaagatcttcatgagc

SEQ ID NO: 33849 - DNA, 1491 bp, Artificial Sequence
  Description of Artificial Sequence: Synthetic coding sequence
atgaccttcaacagctttgaggggtctaaaacatgtgtccctgcagacatcaataaggaggaggaatttgtggaagaatttaacaggcttaagacattcgctaattttcctagcggttctccagtatccgcctccactctggcgagggccggcttcctgtacacgggagagggtgacaccgtgaggtgtttttcatgccatgcggcagttgaccgatggcagtacggagattctgctgttggtcgccataggaaggtgtcccctaactgccgcttcataaatgggttttatttggagaattccgcgacacagtccaccaacagcggtattcagaacggccagtataaagtggagaactatctggggtcccgcgatcactttgccctcgaccgaccgtccgagactcatgctgattacctcctacggaccgggcaggtagtggacatcagcgatacaatttatcctcggaatccagccatgtacagcgaggaagcacgactgaagagtttccagaattggcctgattacgcccacctaacccccagagaattggcctccgctggtctttactatacaggtatcggtgaccaggtgcagtgcttttgttgtggtggaaaactcaagaattgggagccatgcgaccgggcatggagtgagcatcgaaggcattttccaaactgtttcttcgtgctgggccgcaaccttaacatacggtccgagtcagacgccgtaagctctgaccgaaatttccccaactctaccaacttaccccggaaccctagtatggctgactacgaggcacgcatttttacgtttgggacatggatctattccgtgaacaaagagcagctagcaagggccggattctacgctttgggggagggggacaaggtgaagtgcttccactgtggtggggggttaacagattggaagccatcggaagatccctgggagcagcatgctaagtggtaccccggctgcaaatacttactggaacagaaagggcaggaatacatcaataatatccatctgacgcatagcctggaggaatgcctggtcagaactacagagaagaccccctccctaacccggcgcatcgacgataccattttccagaatcccatggtccaagaggccataaggatgggttttagcttcaaggacatcaaaaaaatcatggaagaaaagatacagataagcggaagcaactacaaaagtctcgaggtgctggtggccgacctagtcaacgcacagaaagattccatgcaggacgagtccagtcagacatcactccagaaggaaatctctaccgaagaacagctgaggaggcttcaggaagaaaaactctgtaagatctgcatggacaggaatatcgctatcgtcttcgttccgtgtgggcatcttgtgacttgcaaacaatgcgccgaggccgtcgataaatgcccaatgtgttacaccgtgatcaccttcaaacagaagatcttcatgtct

SEQ ID NO: 33850 - DNA, 1491 bp, Artificial Sequence
  Description of Artificial Sequence: Synthetic coding sequence
atgacattcaactcgttcgagggaagcaagacttgcgtccctgccgacatcaataaagaagaggaattcgttgaagagttcaacaggctgaagacattcgcaaactttccatccgggtcccccgtgtccgcttcaacacttgctagggccggattcctgtatacaggagaaggagacactgttcgctgtttctcatgtcacgcagccgtcgatcggtggcagtacggggatagcgctgtcggcaggcaccgcaaagtgtccccaaattgtcggttcattaacgggttttatctcgagaactcagccactcaaagcacgaatagcggcatccaaaacgggcagtacaaggtggaaaattacctgggttcccgcgatcactttgccctggaccggcccagcgagacccatgccgactacctcctaaggacaggccaggtagttgacatttccgacactatctatccgcgcaatcctgccatgtactcagaggaagcacggctgaagtcttttcaaaattggcccgactacgcgcacctgacaccgcgtgaactcgcctccgccggactgtattacaccggaatcggcgaccaggtgcagtgtttttgctgcggaggtaaactgaaaaactgggagccttgcgatagggcatggtctgagcaccggaggcatttcccaaattgtttttttgttcttgggcgcaacttgaacatcaggtctgagtctgacgctgtcagctcggacaggaatttcccaaattccactaatcttccgcgcaatccctccatggctgattacgaagcccggatatttaccttcggcacctggatctactccgtgaataaggagcagctggctcgtgcagggttttatgctctaggtgaaggtgacaaagttaagtgctttcactgcggcggaggcttaactgactggaaaccgagtgaagatccttgggagcaacacgctaaatggtatcctggttgtaagtacctgcttgaacagaaaggtcaggaatacattaataacatccatttgacacactcactcgaagagtgtttagttagaactactgaaaaaactccctcactgacccggcggattgatgacaccatatttcagaatcctatggtgcaggaggccattcgcatggggtttagtttcaaggacataaagaagatcatggaagagaagatccagataagcggttctaactataagtccttggaggtgctggttgctgacctggtgaatgcccagaaagattcaatgcaagacgaaagctctcaaaccagcctgcagaaggaaatcagcaccgaggaacaactgcgaaggctgcaggaagagaagttatgcaaaatttgtatggatcgaaatatcgccatagtattcgttccgtgcgggcacctcgtgacttgcaaacaatgtgccgaggccgtagataaatgtcctatgtgctatactgtgattacgtttaaacagaagatcttcatgagc

SEQ ID NO: 33851 - DNA, 1491 bp, Artificial Sequence
  Description of Artificial Sequence: Synthetic coding sequence
atgacattcaatagctttgagggaagcaaaacttgcgtgcctgctgatattaacaaggaggaagaatttgttgaagaattcaatagactgaaaaccttcgcaaacttcccatcgggttcacctgtgtcagcgtcaactctcgcgcgagccggcttcctgtacacaggcgaaggtgataccgttaggtgtttttcttgccacgccgctgttgatagatggcagtacggggacagtgccgttggccggcaccgtaaagtttctcctaactgtcggtttattaatgggttctacctagagaatagtgcaactcagtcaactaactcgggtattcagaacggtcaatacaaggttgagaattaccttggttccagagatcacttcgccctggaccggccgagtgagacacacgctgactacttgttaaggacaggccaggtggtggacatctccgacacaatctaccctcggaaccccgctatgtactcagaagaggcccgcctgaagtctttccagaattggccagactatgcccatttaacacctagagagctcgcctcagcgggcctgtactatactggcattggcgaccaggttcagtgtttctgttgcggtggtaaactaaagaactgggagccatgcgaccgggcctggagtgagcatcgcaggcacttccccaactgtttttttgtcctgggcaggaaccttaatatcaggtcagaaagtgatgctgtgtcaagtgacagaaactttcctaatagcacaaacctgccccgcaatcccagtatggcagactacgaagctcgcatatttactttcggcacctggatctattccgtaaataaggagcagctggctagagccggattctatgcgctgggggaaggcgataaggttaaatgcttccactgtggcggtggcctaacggattggaaaccatccgaagacccttgggagcagcacgccaagtggtacccaggatgcaaatacctcctggagcaaaagggccaggagtacataaacaacattcatctcacgcattccctggaggagtgtcttgtgaggaccaccgagaaaaccccctctctaaccaggcgaatcgacgacaccatttttcagaacccgatggtgcaggaggctatcaggatggggttctcctttaaagacatcaagaagatcatggaagaaaaaatccagatctccggctcaaactataagagcttggaagtcctagtggctgacctcgtaaacgcccagaaggactcaatgcaagacgagtcatcccagacttccctgcagaaggagatctcaacagaagagcaactgaggaggttacaggaggaaaaactctgcaaaatctgtatggacaggaacattgctatcgtgtttgtgccatgcggtcatctcgttacctgtaagcaatgcgctgaggcagtggacaaatgtcctatgtgttacactgttatcacatttaaacaaaagatttttatgagc

SEQ ID NO: 33852 - DNA, 1491 bp, Artificial Sequence
  Description of Artificial Sequence: Synthetic coding sequence
atgacttttaatagttttgagggatccaagacatgtgtgcccgctgatataaacaaagaggaagaattcgtcgaggaatttaacaggctgaagacctttgctaacttcccatccggatctcctgtgagtgcatccactttggcaagggcggggttcctctacacaggagaaggtgatacagtgcgatgtttcagctgtcacgctgccgtggaccggtggcagtatggtgattctgcagtaggccgacaccgcaaagtgtcccccaactgccgctttatcaatggattctatttggaaaactccgctacccagtcgacgaacagcggtatacagaacggtcaatacaaggtggaaaattatctggggagtcgggaccattttgcattggatcgtccttcagaaactcatgccgattacctgctgagaacaggtcaggttgtcgacatctcagatactatatatcctcgcaatcctgccatgtattcagaagaggcacgactgaagagctttcagaactggcccgactatgctcacctgacaccaagagaattagcatcggccggtctttactacacaggaatcggtgaccaggttcagtgtttttgctgcgggggcaagttaaaaaactgggaaccatgcgacagagcctggagcgagcataggaggcatttccctaactgctttttcgtgctggggcgcaacctgaacatcagatctgaatccgacgccgttagttcagatcgtaatttcccaaacagcaccaatcttccgcgaaatccatccatggcggattacgaagcccggatcttcacctttggcacttggatctacagcgtgaataaagaacagctggcgagggcgggcttctacgccttgggagagggagacaaagtgaagtgtttccattgtgggggcggactgaccgactggaagcccagtgaggatccttgggagcagcacgctaagtggtacccaggttgcaaatacttgctggagcagaagggccaggaatatatcaacaacattcacctgacacactccctggaagagtgcctggtgcgaacaaccgaaaagactccctccctgaccagacgaatcgacgacacgattttccaaaacccaatggttcaggaggcaatccgaatgggtttttctttcaaagacatcaagaagatcatggaggagaaaatccaaatcagcggtagcaattataaatccttagaggtgctggtggccgacctggtcaacgctcagaaggactcaatgcaagatgagtccagccaaacttcactgcaaaaggagatttctactgaagagcaactgagacgcctgcaggaagaaaaactctgcaagatctgtatggatcgaaatatcgccattgtttttgttccttgtggccaccttgtgacttgtaagcagtgtgcagaagcggttgacaagtgcccaatgtgttatacggtgattacatttaaacagaagatcttcatgagc

SEQ ID NO: 33853 - DNA, 1491 bp, Artificial Sequence
  Description of Artificial Sequence: Synthetic coding sequence
atgacctttaactcatttgagggctccaagacctgcgtgcccgcggacattaacaaggaagaggaattcgtcgaggaattcaacagactcaagactttcgccaatttcccaagcgggtcccccgtgtccgcgtcgactctggctcgcgcaggttttctttacacgggtgagggtgatactgtgaggtgtttttcgtgtcacgccgcggtggaccgctggcaatacggagattccgccgtgggtcggcacaggaaggtttcgcccaactgccgctttatcaacggtttttacctggagaactccgcaactcagagcactaactcgggtattcaaaacggacagtacaaagtggagaattatctggggagcagagatcactttgcacttgataggccatcggaaacccatgcagactaccttctcagaactggacaggtggtggacatatcggataccatttacccaaggaacccagccatgtactcggaggaagcaagacttaagtcatttcagaactggccggattacgcccacctcacgcctcgcgaactggcctcggcaggactgtactatactggaattggggaccaggtccagtgtttctgttgtggagggaagctgaaaaactgggaaccgtgcgatagagcctggtctgagcacaggcgtcatttcccaaattgctttttcgtccttggtcgcaatctcaatattcggtccgagtccgatgcagtgtcctctgataggaattttcctaactcaaccaatctccctcgcaacccttcgatggcagactacgaagcacggatattcacttttggaacttggatttactcagtgaataaggagcaactggccagagccggattctacgcactgggagaaggagataaggtgaagtgctttcattgtggagggggtctgactgattggaagccttccgaagatccttgggaacagcatgcaaaatggtacccaggctgtaaatacctcctggaacaaaaaggacaggaatacatcaataacatacatctgactcattcactcgaagagtgcctcgtccgaactaccgaaaagactccgtccctgactcgacggatcgatgataccatttttcagaatcccatggtgcaagaggcaattcgaatgggttttagctttaaggatatcaaaaagataatggaagagaagattcagatttcaggatccaactacaagagcctggaagttcttgtggcagatctcgtgaatgcacagaaagactcaatgcaggacgaaagcagccaaacctcactccaaaaggagatatcgaccgaagaacagctgagacgcctccaggaagagaaactctgtaaaatctgtatggatagaaacattgcaattgtgtttgtcccttgcggacacctggtcacttgcaagcaatgcgcagaagccgtcgataagtgcccaatgtgttacactgtgatcaccttcaagcaaaagattttcatgagc

SEQ ID NO: 33854 - DNA, 1491 bp, Artificial Sequence
  Description of Artificial Sequence: Synthetic coding sequence
atgacattcaactcttttgaagggtccaagacctgtgtgcctgctgacattaacaaggaagaggagttcgttgaggagttcaatcggctgaagacctttgcaaattttcctagcggctcacctgtgtccgccagcactttagctcgggccggctttctgtacacaggagagggagacactgtgcggtgtttctcttgccacgctgccgtggaccgttggcagtacggcgattcagcagtggggcggcaccgcaaagtttcccccaactgccgctttatcaatgggttctatctcgagaactctgccacccaaagcaccaatagcggcatacaaaacggccagtacaaagttgagaactacctcggatctcgggatcacttcgccctcgataggccctctgagacccacgccgattatctgttacgcaccgggcaggtggtggacatctctgataccatctatccaagaaacccagcaatgtactccgaggaggctagactaaagtcattccagaattggcctgactatgcacacctaactccacgagagctcgcaagcgcaggcctgtactacacaggcattggggatcaggttcagtgcttctgttgcggcggcaaattaaagaattgggaaccctgcgatagggcttggtctgagcatagaaggcactttcctaactgcttttttgtgctgggacgcaatctgaacatacgctccgagtctgatgctgtttcttccgatcggaacttccccaactccactaacctgcccagaaacccaagtatggctgactacgaagcccggatcttcacatttggcacatggatttattccgtgaataaggagcaactagcaagggctggcttttacgccttaggtgaaggggacaaggtgaaatgttttcactgtggaggcggtttaacagactggaagcccagtgaagacccctgggaacagcacgccaagtggtaccctggctgtaaatacctactcgagcaaaagggtcaggaatacatcaacaatattcacttaactcacagtcttgaggaatgtctggtgcgcacaaccgaaaagacaccctccctgaccaggcgaatagatgatacaatattccagaatccaatggtgcaagaggccataagaatgggatttagcttcaaggacatcaaaaaaataatggaggagaaaatacagatctccggcagtaactacaaaagcttggaagtgcttgtagctgaccttgttaacgcacagaaggactcaatgcaagacgagtccagccaaacaagcctgcaaaaggagatttctaccgaagaacagcttagacggctacaggaagagaaactgtgcaaaatctgcatggaccggaacatcgcaatagtgttcgtgccatgcggtcatttagtgacctgtaagcagtgtgcagaggctgttgacaaatgccccatgtgttatactgttattacctttaagcagaagattttcatgagt

SEQ ID NO: 33855 - DNA, 1491 bp, Artificial Sequence
  Description of Artificial Sequence: Synthetic coding sequence
atgaccttcaactcattcgaaggttccaagacctgcgtgccggccgacatcaataaggaggaggaattcgttgaggaattcaatcggctgaaaaccttcgccaattttccgtccggatcgccggtcagtgccagcactctggcacgcgctgggtttctttacacgggggagggcgataccgtccggtgcttttcatgccatgccgccgtggataggtggcagtacggagattccgctgtcggaaggcaccggaaagtgtccccaaactgccgcttcatcaatggattttacctcgagaattcagccactcagtcaaccaactcaggcatccagaacggtcaatacaaagtggagaattacctgggatcgcgggaccacttcgcgttggaccggccatccgaaactcacgcagactacctgcttcgtaccggacaggtggtggatatctcggacaccatctacccgcgcaaccctgcaatgtactcagaagaagctcggctcaagtctttccagaactggccggactacgcccacctcaccccacgcgagctggcgtcagcgggcctttactacaccgggatcggggaccaggtccagtgcttctgttgcggcggaaagctcaagaactgggagccgtgcgaccgggcatggtccgagcataggcggcactttccaaactgttttttcgtgctgggtagaaacctgaacatccggtcggaatcggacgccgtcagctccgacaggaacttcccgaactcgaccaatctgccacggaacccatcgatggctgactacgaagctaggatcttcacctttgggacctggatctactccgtgaacaaggaacaactcgcccgagccggattctatgccttgggggaaggcgacaaggttaaatgcttccattgtggaggaggacttacggattggaagccgtcagaggatccttgggaacagcacgctaagtggtacccgggatgtaagtacctgctggaacagaaggggcaggaatacattaacaacatccacctcactcatagcctcgaggagtgcctggtcagaaccaccgaaaagaccccttcgttgacccggcgcattgacgatacgatctttcaaaacccgatggtgcaggaggcgattcgtatgggcttctccttcaaggacattaagaagatcatggaggagaagatccagatttcaggaagcaattacaagtcgctggaggtcttggtggcggatctggtgaatgcacagaaggactcgatgcaggatgaatccagccagacttccctgcaaaaggaaatctccactgaggagcaactgcgccggttgcaagaagaaaagctgtgtaagatctgcatggaccgcaacatcgcaatcgtgttcgtcccatgcggccacttggtcacgtgcaagcagtgtgcagaagcggtggacaagtgcccgatgtgctacaccgtgatcacgttcaaacagaagatcttcatgtct

SEQ ID NO: 33856 - DNA, 1491 bp, Artificial Sequence
  Description of Artificial Sequence: Synthetic coding sequence
atgacgtttaattctttcgaggggtccaaaacttgcgtgccagccgacattaacaaggaagaagaattcgtggaagagttcaaccgtctgaagacatttgccaacttcccaagtggtagtccagtgagcgctagcaccctggctcgtgctgggttcctgtacaccggcgagggcgacaccgtgcgctgcttctcctgccacgccgcggtggataggtggcagtacggagattctgcagtaggtaggcaccgcaaggttagcccgaattgtcgctttattaacggtttttacctcgagaatagcgcaactcagagcacaaattctggcatccagaacggtcagtataaggtcgaaaattacctcggcagcagagatcattttgctctggacagaccaagcgaaacccacgctgactacctgctgcgtaccggccaggttgtggacatttcggatacgatttacccgcgaaacccggcaatgtattcagaagaggcacgactgaagtcgttccagaattggccggattatgcgcatctgaccccccgtgagctcgcctcagcgggactctactataccggtatcggggatcaggtgcagtgcttctgctgcggcggtaaactcaaaaattgggaaccatgcgaccgggcctggtcggagcatcggcggcactttccaaattgctttttcgtgctgggtcgaaaccttaatatccgtagcgagagcgacgccgtgtctagcgacagaaatttccctaactctactaatctgccgcggaacccaagcatggcggactatgaggcgcgtatatttacttttggtacctggatctattcagtcaataaggagcagctggcccgcgccggattttatgcgctgggtgagggcgacaaagtcaagtgctttcactgcggcggcggtctaaccgattggaagccgtccgaagatccgtgggagcagcatgcgaagtggtatccaggttgcaaatacctgttggagcagaaaggacaagagtacattaataacattcatctgacgcatagcctggaagagtgcctggtgcgaactaccgaaaaaacgccgtctctgacccgtcgaatcgacgatactatctttcagaatcctatggtccaggaggctatccgcatgggcttttcctttaaggatatcaagaaaattatggaggaaaagattcagatcagcggcagtaattataagagcttggaggtgctggttgctgacttggtaaacgctcagaaagactcaatgcaggacgagtcgagccagacatccctgcaaaaagaaatcagcaccgaggagcaactccgccgtttgcaagaggagaaattgtgtaagatttgtatggaccgcaatattgctatcgtgtttgtgccatgtgggcacctggtgacgtgtaaacaatgtgcggaggccgttgataagtgcccaatgtgctatacagtgattactttcaaacagaagatctttatgtcg

SEQ ID NO: 33857 - DNA, 1491 bp, Artificial Sequence
  Description of Artificial Sequence: Synthetic coding sequence
atgacctttaactcgtttgaaggctctaaaacgtgtgtcccagcagatatcaacaaggaagaagaattcgtggaagagtttaatcgcctcaagaccttcgcaaactttccttcggggtcgcccgtcagcgcaagcacgcttgctagagcaggctttctttacaccggagaaggagataccgtgcgttgtttctcctgccacgcagcagtggatcgttggcagtacggtgacagcgcagtgggtcgccatagaaaggtgagcccaaactgtcgctttatcaatggattctacctcgagaattccgcgacccaatcaaccaacagcggtatccagaatggacaatacaaggtcgaaaactacctgggatcgcgtgatcactttgctctcgaccggccatctgaaactcatgcagattacctcctccgcacgggtcaagtggtggatatctcggataccatctaccctagaaatcctgcaatgtactccgaagaagcaagactgaagtctttccaaaactggccagactacgcacaccttactcctcgggaacttgcctccgcaggactctattacaccggaattggcgaccaagtgcagtgtttttgctgtggcggcaaacttaagaattgggagccatgcgacagagcctggtccgagcaccggaggcacttccctaactgttttttcgtgttgggacggaatctcaatatccggtccgagtccgacgcggtttcatcagacaggaattttcccaattccactaatttgccaagaaatccttccatggcagactacgaagcaagaatcttcactttcggtacttggatttactccgtgaacaaggagcaacttgctcgcgcaggattttacgcactgggtgaaggggataaggtcaagtgttttcattgcggtggtggtcttaccgattggaaaccttcggaagatccttgggagcaacatgccaagtggtaccctggctgtaaatacctgctggagcaaaagggacaggaatacattaacaacattcaccttactcactccctggaggagtgtttggtgcgcactaccgaaaagactccctccctgaccaggaggatagacgataccatttttcaaaacccgatggttcaagaggcaattaggatgggattctctttcaaggatatcaagaagattatggaagaaaagatccagatctcgggatcgaactacaagtcgctggaagtgcttgtggctgatctggtgaatgcacaaaaagattcgatgcaagatgaatcgtcacaaaccagcctccaaaaagaaatttcaacggaggagcagctcagaagattgcaagaagagaaactttgcaagatctgcatggaccggaacatcgcaattgtctttgtgccttgtggtcatctggtgacctgtaagcagtgtgcagaggcagtggacaagtgccccatgtgttacacggtgataactttcaagcaaaagatcttcatgtcc

SEQ ID NO: 33858 - DNA, 1491 bp, Artificial Sequence
  Description of Artificial Sequence: Synthetic coding sequence
atgactttcaattctttcgaggggtcaaagacttgcgtgccggccgacattaataaagaagaagagttcgtcgaggagttcaatcggctgaagacgttcgctaactttcccagtgggagccctgtgtccgcctccacccttgctcgggctggcttcctgtataccggggagggagataccgttcgctgcttttcatgtcacgctgccgtagatcggtggcaatacggcgactcagccgtgggacgccataggaaggtgagtccaaactgtcgctttattaatggattctacctggagaactcagccacccagtccactaactccggaattcagaatggacaatacaaggtggagaattaccttgggtctagagatcactttgcgctagaccgcccatccgagacccatgccgactatctcttacgcacagggcaggtggttgacatttctgatacaatctatcctcgcaaccccgccatgtatagcgaggaagcaagactgaagtcttttcagaattggccagactatgcacatttgacgcccagagagctggccagtgctggcctttactatactgggatcggtgatcaggttcagtgtttctgttgcggtggcaagctgaaaaactgggaaccctgcgacagagcatggagtgagcacagacgccattttcccaactgctttttcgtgcttggccgcaatctgaatatccggtctgagtcagatgccgtttcttctgacagaaattttcccaactcaacaaacttgccgaggaacccttccatggcagactacgaggccaggatttttacttttggtacatggatttatagtgttaataaggaacagctggcccgagcaggcttctacgctctcggggagggggataaggtgaagtgttttcactgcgggggcggcctgactgactggaagccctctgaagacccttgggagcagcacgccaagtggtacccaggatgcaagtacttgctcgagcagaaggggcaggaatacatcaataatattcacctgactcactccctggaggagtgcctcgttcggactaccgagaagactcctagtttgaccagaaggatcgatgacacaatttttcagaaccctatggtgcaggaagccattcgcatgggtttcagcttcaaggacataaagaagatcatggaagagaagatacagatctctggatcgaattataagagccttgaagtccttgtggccgacctggtcaatgctcagaaggatagtatgcaggatgaatcctcacagacatcgttgcagaaggagatctctaccgaggaacagctccgacggctgcaagaagaaaaattatgcaagatctgtatggacagaaatatagcaattgtattcgtcccatgtgggcaccttgtgacttgcaaacagtgcgcggaggcggtggataaatgtccaatgtgttataccgtcatcacttttaagcaaaagattttcatgagt

SEQ ID NO: 33859 - DNA, 1491 bp, Artificial Sequence
  Description of Artificial Sequence: Synthetic coding sequence
atgaccttcaacagcttcgaagggtccaaaacctgtgtgcccgctgatataaataaagaggaggaattcgtcgaggagtttaacaggctcaaaacctttgcaaacttcccatccggatctcctgtttcggcgtctactttagcccgtgcaggattcttgtacactggtgagggcgacactgtgcgttgcttttcttgccatgccgccgtcgacagatggcaatacggagacagcgccgtgggacggcatagaaaagtatctcctaactgcagattcatcaatggcttttatctggaaaattccgccactcagtcaactaactctggaattcagaatggccaatacaaggttgagaactatctgggctctcgtgatcattttgcgctggatcgaccctccgagacacacgccgattacctccttcgcactgggcaggtggtggatatctctgacacaatttacccccgaaaccctgctatgtacagtgaggaggcaagattgaagagcttccagaattggcccgattacgcacacttaaccccgcgcgaactggcatcagccggcctctattacaccggcattggcgatcaggtgcagtgtttctgctgtggaggcaagctgaagaattgggagccttgcgatcgtgcctggagcgaacatcgccggcatttcccaaattgttttttcgtcctcggaaggaacctgaacattagaagtgaatccgatgctgtgtcatctgatcgcaacttcccgaattctacgaacttgcctcgcaacccctcaatggccgattatgaagcccgaatatttacttttggtacgtggatctacagtgtgaataaggagcagttggcacgcgcaggcttctacgcattaggagaaggcgacaaagttaaatgctttcactgcgggggtggccttactgattggaagccatcagaggatccatgggagcagcacgccaagtggtacccagggtgcaagtatcttctggagcagaaaggtcaggagtacataaataacatacacttgacacacagcctggaggagtgcttggtgcggacgacagaaaagactccgtccctgacaaggcgaatagacgatactattttccagaaccccatggttcaggaggcgatccgaatgggcttttcctttaaggacatcaaaaagatcatggaagaaaagattcagattagcggtagtaattataaatccttggaggtgctagttgcagatttggtcaacgcccagaaggattcaatgcaggacgagtcctcacaaacaagcttgcaaaaagaaatatcaacagaggagcagctgagacggctccaggaggaaaagctttgcaagatctgtatggatcgcaacattgcgatcgtgtttgtgccctgtggccacttggtaacttgtaagcagtgcgctgaagctgtggataagtgcccaatgtgctatacagtcattacctttaagcagaaaattttcatgtct

SEQ ID NO: 33860 - DNA, 1491 bp, Artificial Sequence
  Description of Artificial Sequence: Synthetic coding sequence
atgacctttaactcctttgagggtagcaagacttgcgtgccagccgatatcaataaagaggaggaattcgtggaggaattcaaccgcctgaaaactttcgcgaattttccatccggaagccccgtgtctgcatcaactcttgcaagggcaggcttcctttacactggtgagggtgacacggtgcgctgcttttcgtgtcatgcggcggtcgacaggtggcagtacggagatagcgcagtcggccgccatcggaaagtgtccccaaattgtcggttcataaacggattttacctggagaactccgcaactcagtcgaccaattcggggatacagaatggtcagtataaggttgaaaactacctgggatccagggaccattttgcactcgatcggccttccgaaactcacgcagattacctgctgcggaccggtcaagtggtggacatcagcgacactatttacccacgcaacccagcgatgtactcggaagaggcccgcctcaagagctttcaaaactggccggactacgcacatctcacccctcgagagcttgcgagcgccggactttactacacgggcattggtgaccaagtccagtgtttctgttgcgggggaaagctcaagaactgggaaccctgcgatagagcatggagcgaacacagacgtcatttcccaaactgcttttttgtgcttggacggaacctcaacatccgttccgaaagcgatgcggtgagctcggaccgcaattttcctaactccactaacctcccccggaacccgtcaatggccgactacgaggccagaatctttacctttggtacgtggatttactcggtgaacaaagagcagctcgcccgggcagggttctacgcactcggggaaggagataaggtgaagtgctttcattgcggtggtggacttaccgactggaagccgagcgaagatccttgggagcaacatgccaagtggtacccaggctgtaaatacctgcttgaacaaaagggacaagagtacattaacaatatacatcttacccattcactggaggaatgtctcgtccgcaccaccgaaaagaccccaagccttacgagacgcattgatgataccatcttccaaaacccaatggtgcaagaggcgataaggatggggttcagctttaaagacatcaaaaagataatggaagagaagattcagatctcagggtcaaactacaagtcattggaagtgctggtggcagacctggtcaatgcccagaaggattcgatgcaggacgaatcgagccaaacgtcactccaaaaggaaatctcgaccgaggagcaactgcgcagactgcaggaggaaaagctctgtaagatttgcatggataggaatattgcgattgtctttgtgccttgtggtcaccttgtgacttgtaagcaatgtgcagaagctgtggataagtgtccgatgtgctacaccgtgattacgtttaaacaaaagatcttcatgtcg

SEQ ID NO: 33861 - DNA, 1491 bp, Artificial Sequence
  Description of Artificial Sequence: Synthetic coding sequence
atgacgttcaattcttttgaggggtcaaaaacttgtgttccagcagacataaacaaagaggaagagttcgtggaagaattcaacagattgaaaacttttgcaaattttccgtcaggatcccctgtgagcgcttcaacattggcaagagctggctttctgtatacaggagaaggagatacagttcgttgtttctcctgtcacgccgccgttgatagatggcagtatggagattcagctgtaggacgacatcggaaggtgtccccaaattgtcgtttcattaacggattttatctagaaaattctgccacacaatctactaacagcgggatacagaatggtcaatataaggtcgaaaattatttgggaagtagagatcattttgctcttgaccgaccaagtgaaacacatgccgattatttgctacgaactggacaagtggtagatatttcggatacaatttatccaaggaatccggctatgtactccgaggaagcacgacttaagagttttcaaaactggccagattatgctcacctcactccgagagagcttgcatcggcaggattgtattacactggaattggtgaccaagtccaatgtttctgttgtgggggtaaactcaaaaattgggagccatgtgatcgcgcgtggagtgaacatcgtcggcactttccaaattgctttttcgttctcggtaggaatttgaacattcgatctgagagcgatgcagtttcatccgaccggaacttcccgaacagcacaaatctcccacgaaatcccagtatggcggattatgaagcccgtatctttacatttggtacatggatttattcagttaacaaggaacagttagcacgagcaggtttttacgcactgggagaaggagataaggtgaagtgctttcattgcggtggtggattgactgattggaaaccatcagaggatccatgggaacagcatgctaaatggtatccaggctgtaaatatttgctcgaacaaaagggccaagaatacatcaacaatattcaccttacccactctttggaggaatgtcttgtccgaactaccgaaaagactccaagccttacaagaaggattgatgatactatctttcaaaatccaatggtacaagaagcaattcgaatgggtttttctttcaaggatattaagaaaatcatggaagagaaaatccaaatttccggatctaattataaaagcctcgaagttttggtggccgatttggttaatgctcaaaaggacagtatgcaagatgagtcatcgcagacttctttacaaaaggaaattagtacggaagagcagcttcgtcgacttcaggaagagaagctatgcaaaatatgtatggatcgaaatatcgctatcgtttttgtgccatgtggacatcttgtcacctgtaaacaatgcgctgaagctgttgataagtgccctatgtgctatacggttattacttttaagcaaaaaatctttatgtcc

SEQ ID NO: 33862 - DNA, 1491 bp, Artificial Sequence
  Description of Artificial Sequence: Synthetic coding sequence
atgacatttaactcgtttgaaggctctaagacgtgcgtccccgctgacatcaacaaggaagaggaatttgtagaggaattcaatcgcctaaaaaccttcgcaaacttccccagcggatcacccgtgtcagccagcacactagctagagcagggtttttgtatactggcgaaggcgacacggtcaggtgtttttcctgtcatgccgctgttgatcgatggcaatacggcgactcagccgtgggccgccacaggaaggtttcacctaactgccgttttataaacggattttacttagaaaacagtgcaacacaatctacaaactcaggaatacaaaacggtcaatacaaggtcgagaactatctggggtctagggaccactttgccttggataggcctagcgagacacacgcagactatctgctacgaactggccaggtcgtggatatatccgacactatttatccccgcaacccggctatgtacagcgaagaagctcggctgaagagcttccagaactggcctgactacgctcatctcacgcccagagaactggcatccgctggtttgtactatacaggaatcggcgaccaggtgcaatgtttctgctgcgggggtaagcttaaaaattgggagccgtgcgatagggcttggagtgagcatagacgtcatttcccaaattgtttttttgtcctggggaggaacctcaacattcgcagcgagtcagacgccgtgtcttctgaccgtaattttccaaacagtacaaacctaccgcgcaaccccagcatggccgattacgaagcccggatttttacttttggcacgtggatctactcggtcaacaaagagcaattagcacgggcaggattctatgctctgggagagggcgacaaagtcaagtgctttcattgcgggggcggacttaccgattggaagccctccgaagatccgtgggaacagcatgcgaagtggtatcccggctgcaagtatctactagaacaaaaggggcaagaatatattaacaatatccacctgacacactcccttgaggaatgcctggttagaacaactgagaagacgccgtcccttacacggcggatagacgacaccatctttcagaacccaatggtacaagaggccatcagaatggggtttagttttaaagacattaaaaagatcatggaggagaagatacaaatatctgggtccaactacaagtcactggaagtcctggtggccgatctcgtcaacgctcagaaagatagcatgcaggacgaaagctcacagacgagcctccagaaagagatcagcacggaggaacaactgagacggctgcaggaagagaagctgtgtaaaatttgtatggaccgaaacatagctatagtgttcgtaccatgcggccacctggtgacctgtaagcagtgcgccgaagctgtggataagtgccccatgtgttatacagttatcaccttcaaacaaaaaatctttatgagc

SEQ ID NO: 33863 - DNA, 1491 bp, Artificial Sequence
  Description of Artificial Sequence: Synthetic coding sequence
atgactttcaactcctttgagggatcaaagacgtgcgtgccggctgacattaacaaagaggaagagttcgtcgaggagttcaacaggctcaagacatttgctaacttcccgtctgggtcgccagtgtcagcgagtactctagcaagagcggggttcctatacacaggagagggcgacaccgttagatgcttctcatgccatgctgcagtcgatagatggcaatatggtgactccgccgtggggcggcaccggaaagtgtcacctaactgtagattcattaatggtttctatctggagaactctgcaacgcagtcaactaactcggggatacaaaacgggcagtataaggtggagaattatctcggttcaagagatcacttcgccctggacaggcccagcgaaacccacgccgactacctgttgagaacaggacaggtggtggatattagcgatacaatctatccgaggaatcctgccatgtactcagaagaggcaaggctgaaatcttttcagaactggcccgattatgctcacctgacccctagggagctggcctccgcaggtttgtattatacaggcattggcgatcaggtccagtgtttttgttgcggaggcaagttaaagaactgggagccttgtgaccgcgcctggtcagagcacagaaggcacttccctaactgcttctttgtgctggggcggaatctgaatatccgatccgagagtgatgccgtcagcagcgataggaatttccctaactctactaacctgcctcggaatccaagtatggcagattatgaggccaggatcttcacattcggaacttggatttactccgtgaataaagaacagttagcccgcgccggattctatgctctcggtgaaggggacaaagtgaaatgttttcactgtggtggaggcctcactgactggaaaccttcggaagacccctgggagcagcatgcgaagtggtaccctgggtgtaagtacttgctagagcagaaaggccaggaatatatcaataacattcatctcacacattcactggaagagtgcctcgttcgtaccaccgagaagacacctagcctgacgagacgaattgatgatacaatcttccagaaccccatggtgcaggaagcaattagaatgggcttctcattcaaggatatcaagaagattatggaggagaagattcagatctcgggctctaattataagtcgctggaggtactggtggccgatttggtgaacgctcagaaggattctatgcaagacgaaagttctcagacctccctgcagaaagaaatctccactgaggagcagctgaggagacttcaggaggagaagctgtgtaagatttgtatggacagaaacattgcaatcgttttcgttccttgtggacatttggtcacctgcaagcagtgcgccgaagcggtggacaaatgccctatgtgctacacagtgattactttcaagcaaaaaatatttatgtca

SEQ ID NO: 33864 - DNA, 1491 bp, Artificial Sequence
  Description of Artificial Sequence: Synthetic coding sequence
atgactttcaactcgttcgagggctctaagacatgtgtgccggctgacattaacaaggaggaggaatttgtcgaagagttcaatcgcctgaagaccttcgcaaatttcccctcaggctcgccggtgtccgcctccacgctcgcccgagcggggtttctgtacacaggggagggggacactgtccggtgcttctcatgtcatgccgccgtggaccggtggcagtacggtgacagcgctgtcggacgacatcgcaaggtctcccccaactgccgtttcattaacggtttctatttagagaattccgcgacacagagcacgaactccggtatacagaacggccaatataaggttgagaattacctggggagccgtgatcacttcgctttggaccgcccatcggagacgcacgccgattacctgctgaggactggccaggtggtggatatctccgacaccatttacccgcgcaacccggctatgtactcagaagaggcacgcctgaagtcctttcagaattggccagactatgcacatctgacgcccagagaactggcctcagccggtctgtactatactggaataggcgatcaagtacagtgcttttgctgtggcggcaagctaaagaactgggaaccgtgcgaccgcgcgtggtcggagcaccgacgacacttccctaattgttttttcgtgctgggcagaaacttaaacatacgtagtgagagtgatgccgtctcttcggatcggaatttcccaaacagcaccaacttacctcgcaatccatcgatggccgactatgaagcgcggatcttcactttcggaacatggatatactccgtaaacaaggagcaactggctcgagccggtttttacgccctgggcgagggtgataaggtcaagtgcttccactgcggcggaggtctgactgactggaaaccatctgaggatccctgggagcagcatgccaaatggtatcccggctgcaagtacttactggagcagaagggccaggagtacatcaataacattcatctgacccacagcctagaggagtgcctcgttcgcacgactgaaaaaaccccctccctgacgcgtcggatcgatgatacgatcttccagaatccgatggtccaggaggcgatcaggatgggcttcagctttaaggacatcaaaaagatcatggaggagaaaatccaaatttccggcagcaactacaagagcctggaggtccttgtagcggacttggtgaacgcgcagaaggattcgatgcaggacgagagcagccaaaccagcctgcagaaggagatttcgactgaggagcaactgagaaggctgcaagaggagaaattgtgcaaaatctgcatggatcgtaacattgccattgttttcgtcccttgtgggcatctggtgacatgcaagcagtgcgccgaggctgttgataagtgtccgatgtgctataccgtgatcaccttcaagcaaaagattttcatgtca

SEQ ID NO: 33865 - DNA, 1491 bp, Artificial Sequence
  Description of Artificial Sequence: Synthetic coding sequence
atgacctttaactcgttcgaaggttctaagacgtgcgtgccagcagatatcaacaaagaggaagagtttgttgaagaattcaacaggcttaagacgttcgccaattttccctcgggctccccagtgagcgcaagcaccctcgctagagccggatttctgtacactggcgaaggagataccgtccggtgcttcagctgccatgccgccgtcgacagatggcaatacggggattccgcagtgggtcggcatagaaaggtgagccccaattgtcgtttcattaacggattttacttggagaattcggccactcagtcgacgaactcaggcatccaaaatggacagtacaaggtggagaactacttgggatcgagagatcactttgccttggaccgaccttccgaaactcatgcggattacctgctgaggaccggtcaagttgtcgatatttccgatacgatttaccctcggaatcctgcaatgtacagcgaggaagcgagacttaagtcgtttcaaaactggccagattacgcccatcttaccccacgtgaattggcctcagctggcctgtactacactggaattggcgatcaggtgcagtgtttctgctgtggtggaaaactgaaaaactgggaaccttgcgacagggcatggtcagagcaccggcgacactttccgaattgctttttcgtgcttggacggaaccttaacattcgatcggagtcagatgccgtgagctcagaccggaactttcctaactcgaccaaccttccacgcaatccttcaatggcagattacgaggcacggattttcacctttggtacctggatttactcggtgaacaaggagcagctcgcaagggctggattctacgcgctcggagaaggagataaggtgaaatgctttcactgtggcggggggcttaccgattggaaaccgagcgaggacccctgggagcaacatgcaaagtggtacccgggttgcaagtacctgctggaacagaagggtcaagaatacattaacaacatccatcttactcattccctcgaagaatgtctggtgcgtacgaccgaaaagacgccctccctcactcgcagaattgacgataccatcttccagaaccccatggtgcaagaagccattaggatgggattctcctttaaagatatcaagaaaatcatggaagagaaaattcagatttcaggttcgaattacaagtcactggaagtgctggtggcagaccttgtcaacgcccaaaaggattctatgcaggacgaatcgagccagacttcactgcaaaaggaaatcagcactgaagagcaactccgtcggctgcaggaagagaagctgtgtaagatatgtatggatagaaacatcgccatcgtgtttgtgccctgtggacatctggtcacttgcaaacagtgcgctgaagcagtggataagtgtccaatgtgttatactgtgattacctttaagcaaaagatctttatgtca

SEQ ID NO: 33866 - DNA, 1491 bp, Artificial Sequence
  Description of Artificial Sequence: Synthetic coding sequence
atgacctttaacagctttgaaggatctaagacgtgtgtcccagctgacataaacaaggaagaagaatttgtggaggaattcaacaggcttaagacttttgcaaatttcccttccggatcacctgtgtcggcttcgactcttgcacgagcaggcttcctttacactggagagggggataccgtgagatgtttcagctgccatgcagccgtggacagatggcagtacggagattcggcagtgggacggcatcgcaaggtcagccctaactgtaggtttatcaacggattttaccttgaaaactccgccacccaatccactaacagcggaattcagaatggacagtacaaagtggaaaactacctggggagccgcgaccacttcgcccttgatcgaccatcagaaactcatgcagattacctccttcggactggccaggtcgttgatatttcggataccatttacccccgtaatccagcaatgtattcagaagaggcacggctgaagtcctttcagaattggccagattacgcgcacctgaccccccgggagctggcttcagcaggactgtactacactgggatcggtgatcaggtccaatgtttttgttgcggagggaaacttaagaactgggagccatgtgatagagcatggtccgagcataggagacattttccgaactgcttttttgtgctgggacggaacctcaatattcggtcagaatctgacgcagtgtcctcggatagaaactttcctaattccactaaccttcctcgtaatcccagcatggcggactacgaagccaggatctttactttcgggacctggatatactcggtcaacaaggagcaacttgcacgcgccggattctacgcactgggtgagggtgataaagtgaagtgttttcactgtggtggaggccttaccgattggaagcctagcgaagatccatgggaacagcatgcaaaatggtacccaggttgcaaatacttgctggaacaaaagggtcaagaatacattaacaatatccaccttactcactcccttgaagagtgtctggtgcgtaccactgagaaaactcctagcctcaccagaaggattgatgacacgatttttcagaaccctatggtccaagaagccatccgaatgggattctcgtttaaggatatcaaaaagattatggaggaaaagatacaaatttcgggctcaaattacaaatcccttgaagttctggtggcagatcttgtgaatgcacaaaaggattccatgcaagatgaatcgtcgcagacctctcttcaaaaggaaatctcaacggaagaacaacttagacgactccaggaagaaaaactctgtaagatatgtatggatcgcaatatcgcaatagtttttgtcccatgtggtcacctcgtgacttgtaagcagtgtgcagaagccgtggataaatgcccgatgtgctacacggtgattacctttaagcagaagatctttatgtca

SEQ ID NO: 33867 - DNA, 1491 bp, Artificial Sequence
  Description of Artificial Sequence: Synthetic coding sequence
atgacattcaactcatttgagggcagtaagacatgcgtgcctgcggatattaacaaggaggaagaattcgttgaggaatttaatagactgaaaacatttgcgaactttccgagcggctcacccgtcagtgcgtcaaccctggcccgagctggctttctatacactggcgagggcgacacggtacggtgtttttcctgccacgccgccgttgatcgctggcagtacggcgactctgcagttggccgacacaggaaggtgtcccctaattgtcgattcatcaacggcttctacctggaaaacagtgccacacaaagcaccaactctggaattcagaatggacaatacaaagtcgaaaactatcttggatcaagagaccactttgccctcgacaggccttcggaaacccacgctgattacttgttgcgaacgggacaggtggtggatatatccgacaccatttacccacgaaacccagctatgtatagtgaagaggcgcgtcttaaaagctttcagaattggcccgattacgctcatctgacaccccgagagctggcctccgcagggctgtattacacaggcatcggtgatcaagtgcaatgcttctgctgcggcggaaagctcaagaattgggaaccctgtgacagagcctggagcgagcatagacgacactttcctaactgtttttttgtgctcggtagaaatctgaatataaggagcgaatcagacgcagtctcgtctgacagaaactttcccaattcaacgaaccttcctaggaatccctctatggctgactacgaggccaggattttcacattcggcacgtggatctattctgtgaacaaggagcagctggctagggcagggttttacgccctcggcgagggagacaaggtcaagtgtttccactgtggtggcggactcacggattggaagccgtccgaggacccatgggaacagcacgccaaatggtatcctgggtgcaaatatttgctggaacaaaaagggcaggagtatatcaataatatacacctgacccatagcctcgaggaatgcctggtaagaacgactgagaagaccccatccctgactaggcgcatagacgatacaatcttccagaaccctatggtgcaggaagctattagaatgggtttcagctttaaagacataaaaaaaatcatggaggaaaagatccagatatcgggatccaattataaaagcctggaggtgctagtagcagatctcgtgaatgctcagaaggacagcatgcaggatgaatcaagtcagacttctctgcagaaagaaatctccaccgaggaacagctgaggcgcctccaggaagagaagctctgtaagatttgcatggatcgaaacatagccatcgtgttcgtgccatgcggacatttagtgacgtgcaagcagtgcgcggaagccgtcgacaagtgtcccatgtgctataccgtcatcacctttaaacagaagatcttcatgtct

SEQ ID NO: 33868 - DNA, 1491 bp, Artificial Sequence
  Description of Artificial Sequence: Synthetic coding sequence
atgacctttaactcattcgagggcagcaagacttgcgtcccggcggacataaacaaagaggaggagtttgtggaggagttcaataggctgaaaactttcgccaatttcccgtccggttcaccggtgagcgcctcgaccctggcgagagcaggattcttgtacaccggggaaggagacaccgtccgctgcttttcgtgccacgccgccgtggacagatggcagtacggtgacagcgccgtgggacgtcatcgaaaagtgtcgcccaactgccgcttcatcaatgggttctatctggaaaattccgcgactcagtctaccaactcaggaattcaaaacgggcaatacaaagtcgagaactacctcggatcacgcgatcacttcgcgctggaccgcccatcggagactcatgctgactacctgcttcgcactggccaggtggtggatatttctgataccatctaccctaggaatccggccatgtactcagaagaagcccggctgaagtccttccagaattggccagattacgcgcatctcaccccgcgggaactggcgtcagccggactctactacactgggatcggggaccaagtgcagtgcttctgctgcggcggtaaactgaaaaactgggagccatgcgatcgcgcatggtccgagcatcggagacacttcccgaactgctttttcgtgcttggaaggaacttgaatatccggtccgaatcggacgcagtgtccagcgacaggaatttcccgaattcgactaatctcccgcgcaacccgtctatggccgattacgaagcgagaatcttcactttcggaacctggatttactcggtgaacaaagaacaactcgcacgcgcgggcttctatgccctcggagaaggagacaaggttaagtgttttcactgcggtggaggactgaccgactggaagcccagcgaggacccgtgggaacaacatgcgaaatggtacccgggctgcaagtacctcctcgaacagaaaggccaggagtacattaacaacatccatctcactcattcccttgaggagtgcctggtgcggactactgaaaagaccccgtcgctgactcggcggatcgatgacaccatcttccagaatccaatggtgcaggaggcaatcagaatgggtttctcgtttaaagatatcaagaagatcatggaggagaagatccagatttcaggatccaactacaaatcccttgaggtgctggtcgccgacctggtgaatgcacagaaggattccatgcaggacgaatcctcccaaacctcactgcagaaggaaatctccactgaggaacaactgcggcggctccaagaagaaaagctgtgcaagatttgtatggatagaaatatcgctatcgtgttcgtcccatgtggacatctggtgacgtgcaagcagtgcgccgaagccgtggacaagtgtccaatgtgctacaccgtcatcacctttaagcagaagatcttcatgagc

SEQ ID NO: 33869 - DNA, 1491 bp, Artificial Sequence
  Description of Artificial Sequence: Synthetic coding sequence
atgacttttaacagttttgaggggtctaaaacttgcgtgcctgctgacattaataaagaagaagaattcgtggaagagttcaatcgtctaaagacctttgcaaatttcccttcggggagccctgtcagcgccagcacacttgctagagccggattcctctataccggcgagggagataccgtccggtgcttctcgtgccacgctgcagtggacagatggcagtatggggattcagcagtcgggagacaccggaaagtgtctcccaactgccgcttcataaacggtttctaccttgaaaactctgctacacaatctacgaattccggcattcagaatggacaatacaaggttgaaaactatctcggatctcgggaccactttgcactggaccgccctagtgagacccacgcagactatctacttcgcacgggacaagttgtggatataagcgataccatctacccaaggaaccctgccatgtacagtgaagaagcccgcctcaaatccttccaaaattggcctgattacgcccaccttaccccaagggagctggcatcagcaggcttgtactatacaggcatcggagaccaggtacaatgcttttgttgcggaggaaaactaaagaactgggagccttgtgacagggcttggagcgagcataggcggcacttcccaaactgcttcttcgtgttgggaagaaacctaaatatcaggagcgaatctgacgccgtgagcagcgatcgcaacttcccaaactcaaccaacctgccgcgtaatccttcgatggctgattacgaagcacgtatcttcacatttggcacctggatctactccgtgaacaaggaacagctcgctcgggccggcttctatgctctgggggagggcgataaagtcaaatgtttccactgtggaggtggcctgaccgactggaagccctctgaggacccctgggaacaacatgctaagtggtaccccggctgcaaatacctcctggagcaaaagggccaagagtatatcaacaatatacacctcacgcatagcctcgaggagtgcctggtgcgtaccaccgagaagactcctagcctgacaaggaggattgatgacactatctttcaaaaccctatggttcaagaagccatccgtatgggcttcagtttcaaggacatcaagaaaattatggaggagaaaattcagatctctggatccaactataagtctctggaggtcctcgtggccgacctcgtgaacgcacagaaggattctatgcaggacgaaagtagtcagacaagcctgcaaaaggaaatctccactgaagaacagctgaggagacttcaggaggaaaagctgtgtaagatctgtatggatagaaacatcgctatcgtcttcgtgccctgcgggcatctcgtcacctgcaagcagtgcgctgaagccgtggacaagtgtcccatgtgttacactgtaatcaccttcaagcaaaaaatcttcatgtca

SEQ ID NO: 33870 - DNA, 1491 bp, Artificial Sequence; identical to SEQ ID NO: 33803
  Description of Artificial Sequence: Synthetic coding sequence

SEQ ID NO: 33871 - DNA, 1491 bp, Artificial Sequence
  Description of Artificial Sequence: Synthetic coding sequence
atgaccttcaactcctttgagggcagcaagacctgcgtacccgccgacatcaacaaagaagaggaatttgtggaggaattcaataggctgaagacatttgctaacttcccctccggttctcccgtgtccgccagcaccctggccagagccggtttcctttataccggcgaaggcgacaccgtgaggtgcttctcatgccatgcggcagtagacagatggcaatacggtgactctgctgtcggcagacataggaaggtgtctcctaactgcaggttcatcaatggattttacctcgagaattctgccacacagtctactaactccggtatccagaacggacaatataaggtggaaaattacttgggaagccgagatcacttcgccctggataggccatcagaaacgcacgcagactacctgctccgcaccggccaggtcgtggacatttccgacacaatttaccctaggaacccagccatgtattctgaggaggctcgcctgaagtcattccaaaattggccagattatgcgcacttgacccctagggagcttgcaagtgcaggattgtattacacggggataggcgatcaggtgcagtgcttctgttgcggggggaagctcaagaactgggagccctgtgatcgggcttggagtgaacacaggaggcattttcccaactgtttcttcgtgctcgggcgcaacctgaatattagatctgagtcagatgctgtgagttccgaccggaacttccccaattccaccaatctgcctaggaatcccagtatggcggattacgaggcaaggattttcacgtttggcacatggatatacagtgttaataaggagcagctggctcgcgctgggttctacgctctgggcgaaggtgacaaagtgaagtgtttccattgcggcggcggcttgaccgattggaagcccagcgaggatccatgggagcagcacgcaaaatggtaccctggatgcaaatatctgttggagcagaaaggccaggaatatatcaacaacattcatctgactcattcccttgaggaatgcctcgtgcggactactgagaagacaccttccctgacccggaggatagacgacaccattttccagaatcccatggtgcaggaagctatccgaatggggttctcattcaaggacataaagaaaattatggaagagaagattcagatatccggtagcaactacaaatcacttgaggtgttggtggccgacctcgtgaatgcccagaaggactctatgcaggatgaatcatcacagacaagcctgcagaaagaaataagcacagaggagcagctgcggcgcttgcaagaggaaaaactgtgcaagatatgcatggatcgcaacatagctatcgtattcgtgccttgcggacacctcgtcacctgtaaacaatgcgcagaagcagtggacaaatgtccaatgtgctatactgtgattacatttaaacaaaaaattttcatgagc

SEQ ID NO: 33872 - DNA, 1491 bp, Artificial Sequence
  Description of Artificial Sequence: Synthetic coding sequence
atgaccttcaactcttttgaagggtcgaagacttgtgtgcctgcagacatcaacaaggaagaggagttcgtcgaggagttcaatagacttaaaaccttcgcaaatttcccttctggatcacctgtgtcggcaagtactctcgctagggctgggttcctttacaccggagaaggcgacactgtgagatgtttttcatgccacgccgcggtggaccgctggcagtatggcgactccgccgtaggccgccaccgcaaggtgtctcccaactgccgttttataaatggattctatttagagaacagtgccacgcagagcaccaactcagggatccagaatggccaatataaggtggaaaattatttggggtctcgcgaccatttcgcgcttgatcgtccatcagagacccatgccgactatctgctgcgtacagggcaggttgtcgatataagcgacaccatatacccccgaaatccggctatgtactcagaagaggccagattgaagagtttccagaattggcctgattatgcacacctgacaccccgagagcttgcgtccgccgggttgtactacacaggcataggagaccaggtccagtgcttttgctgcggcgggaaactcaaaaactgggaaccctgtgacagagcctggagcgaacacaggaggcacttccccaattgctttttcgtgctcggccgcaacttgaacattcgttccgagtctgacgccgttagctccgatagaaactttcctaacagcaccaatctgccgcgcaacccctcaatggctgactacgaggcaaggatcttcactttcggaacttggatttatagtgtgaacaaggaacagctggcgcgggctggattctatgccctgggagagggggataaggtgaagtgtttccattgcgggggcgggctcacagactggaagccgagtgaggatccctgggagcagcacgccaaatggtacccagggtgtaagtatctcctggaacagaaaggccaggaatacataaacaacattcacctgacccactcacttgaagaatgcttggtgagaactacagagaagacaccttcactgacaaggagaatagatgacactatttttcagaatcccatggtgcaagaggctattagaatgggctttagctttaaagacatcaaaaagatcatggaggaaaaaatccagatttccggtagtaattataaatccctagaggtgctcgtagcagatctggtgaatgctcagaaggattctatgcaagatgaaagtagccagaccagcctccagaaggagatctctacagaagagcagttgaggaggctgcaggaagaaaagctttgcaagatttgtatggacaggaacatcgccatagtctttgtgccttgtggccatttggttacctgcaagcagtgtgccgaagctgtggataaatgccctatgtgttacaccgtgatcaccttcaaacagaagatcttcatgtcc

SEQ ID NO: 33873 - DNA, 1491 bp, Artificial Sequence
  Description of Artificial Sequence: Synthetic coding sequence
atgacattcaactcattcgaagggagtaaaacttgcgtgcccgccgatatcaataaagaagaagaatttgtagaggaatttaacaggctgaaaacattcgccaattttccctctggatccccagtgtccgcatctacacttgccagagctgggtttctgtatacaggggaaggagatacagtcaggtgtttttcttgccacgcagccgtggaccgctggcagtatggagattctgccgtgggacggcatagaaaagtaagtcctaattgccgattcataaatgggttctacctcgagaattctgccactcagtccacaaactcagggatccagaacggacagtataaagttgaaaattatcttggatctagggatcattttgcccttgacagaccttcagaaactcacgcggattatctgctcagaacagggcaggtggtcgatatctcagatacaatatatcctagaaaccctgcaatgtatagtgaggaagctcggctgaagtcatttcagaattggcccgattatgcccacctgacaccccgggaactcgcttctgctggactctattatactgggatcggagatcaggtgcagtgcttctgttgcggagggaaactgaaaaattgggaaccctgcgatagggcatggagtgagcacagacggcatttccctaactgcttttttgttctcgggaggaatctaaatatacggtctgaatctgatgcagtctcaagtgataggaatttccctaattctactaatttgccacgaaatccttcgatggcagattatgaggctcgaatatttacttttggaacatggatatactcagtcaacaaagaacagctcgcaagggcgggattctatgccttgggggaaggggataaagttaaatgttttcactgcggaggggggctcacagactggaaaccctcagaagacccatgggagcaacatgccaaatggtatcccggatgcaaatatttgctggaacagaaaggacaggagtatataaataacattcacttgacacacagtctggaagaatgtttggttcggacaacagagaagactccatcactaactaggaggatcgatgatacaatctttcagaatccaatggtgcaggaggcaatacggatgggattctcatttaaagacataaaaaaaataatggaagaaaagatccagatttctgggagtaactacaaatccctagaagtactcgtagctgatctcgttaacgctcagaaagattctatgcaggatgagtcgtcacagacttcactccagaaagaaatatctacagaagaacaattaaggcggttacaggaagaaaaactgtgtaagatctgcatggacagaaatatagcaatcgtgtttgttccttgcgggcatctcgtaacttgcaaacagtgtgcagaagccgttgataaatgtccaatgtgctacacagttattactttcaaacagaaaatttttatgtcc

SEQ ID NO: 33874 - DNA, 1491 bp, Artificial Sequence
  Description of Artificial Sequence: Synthetic coding sequence
atgacatttaattcttttgaggggtctaaaacatgcgtaccagcggatatcaacaaagaagaggaatttgtggaagaatttaatagattaaaaacatttgcaaatttcccctcaggatccccagtgagtgccagtacattagctcgggctgggtttctctatactggggaaggagatacagtcaggtgtttttcttgccatgccgcagttgataggtggcagtatggagattccgccgtggggagacataggaaagtctctcccaactgccgtttcataaatgggttttacctagaaaactctgctacacagagtactaactctggaatacagaatggacagtataaggtggagaattacctggggtctcgggatcactttgctcttgatcgaccatccgaaacacatgccgactatttactcagaacgggacaagttgtggatatctccgatactatataccctcggaaccccgctatgtattccgaagaagcgagacttaaatccttccagaattggcctgactatgcccaccttactcccagagaactcgcctctgccggactatattatacagggatcggagatcaagttcagtgtttttgctgtgggggaaaacttaaaaactgggaaccctgcgatagggcctggtctgagcaccggcgccattttccaaattgttttttcgttctcggaagaaatctgaatataaggtccgaatctgatgccgtgtcctcagatcggaactttcccaactctactaatcttcctcgaaacccatccatggccgattatgaggcacgaatatttacatttgggacatggatatacagtgtcaataaagagcagctggcacgagccggattttatgctttgggggaaggagacaaagtgaaatgtttccattgcggaggaggattgacagattggaaaccttcagaggatccctgggaacagcacgcaaaatggtatcccgggtgtaaatatctgctcgagcagaaaggacaagaatatattaataacattcacttaactcattctctcgaagaatgcctcgtgcgcacgacagagaaaactccatctttaactcgccggattgatgatacaattttccagaatccaatggtgcaggaggcaatacgcatggggttctctttcaaagatattaaaaagatcatggaggagaagatacagatctctggatcaaattacaaatctctcgaagtgcttgtggctgatctagtgaatgcccagaaagattcgatgcaggatgaaagttcacagacatctcttcaaaaagaaatctctacagaagagcagctcaggagactgcaggaagaaaaactctgcaaaatatgcatggatcgaaacatcgccatagtgtttgtaccatgcgggcatctcgtcacatgtaagcagtgtgccgaagctgtcgataagtgtcccatgtgttatactgtgataacattcaaacagaaaatatttatgtct

SEQ ID NO: 33875 - DNA, 1491 bp, Artificial Sequence
  Description of Artificial Sequence: Synthetic coding sequence
atgactttcaactccttcgagggaagcaagacttgtgtccccgccgacattaacaaggaagaagaattcgtggaagaattcaaccgccttaagacgttcgccaatttcccgtcggggagcccagtctccgcatcgaccctcgcccgcgcaggatttctgtatactggagagggtgatactgtccggtgcttttcatgtcatgccgccgtggaccgctggcagtacggggatagcgctgtgggccgccacagaaaagtgtcaccgaattgcagattcattaatggcttttacctggaaaactcagccacccagtccaccaattctggaatccaaaacggccagtataaggtggagaactacctgggctcaagggaccacttcgcacttgatcgcccatccgaaacccatgctgattacctgctccgcactggacaggtagtggatatctctgacactatctatccgaggaacccggccatgtactcggaggaggcacgactcaagtcatttcagaactggccagattacgcacatctcactccacgggaactggcgagcgctgggctgtactacactggaatcggagatcaagtccagtgcttctgctgcggtggaaagctgaaaaactgggagccttgtgaccgggcctggtcagaacaccggcgccatttcccgaactgcttcttcgtcttgggccgcaacttgaatatcagatcggaaagcgacgccgtctcttccgaccgcaacttccccaattccaccaacctccctagaaacccgtccatggcggattacgaggcacgcatctttactttcggtacctggatttactcggttaacaaagagcaacttgcaagagctggattctacgcgctcggcgaaggagacaaagtgaagtgtttccactgcggtggtggtctgaccgactggaagccgtcggaagatccgtgggaacaacatgctaagtggtaccccggctgtaagtacctcctcgaacagaaaggccaagaatacatcaacaatatccatttgacccactcattggaagagtgtcttgtccgcacgactgaaaagaccccctcactcacgcggcgcatcgacgatactatcttccaaaacccaatggtccaggaagccattcgcatgggattctctttcaaagacattaagaagatcatggaggagaagatccaaatctctggatccaactacaagtcgctggaagtgctggtggcggacctggtcaacgctcagaaggattccatgcaagacgaatcctcgcagacctcacttcagaaggagatctcgacggaggagcagctgcgccgcttgcaggaggagaaattgtgcaagatttgcatggatagaaacatcgcaatcgtgttcgtcccttgcggacacctggtgacctgtaaacaatgcgcagaagctgttgacaagtgcccaatgtgctacactgtgatcaccttcaagcagaaaatcttcatgagc

SEQ ID NO: 33876 - DNA, 1491 bp, Artificial Sequence
  Description of Artificial Sequence: Synthetic coding sequence
atgacttttaattcttttgaaggttcaaaaacttgtgttccagcagatattaataaagaagaagaatttgttgaagaattcaatagattaaaaactttcgctaactttccttctggaagtccagtatctgcttcaacattagctagagctggatttctttacactggagagggagataccgtaagatgtttttcatgtcacgctgctgtagatagatggcaatatggtgactcagcagttgggagacatcgaaaagtatcaccaaattgtagattcattaacggtttttaccttgaaaattctgcaactcaatctactaattcaggaatccaaaatggtcaatataaggtagaaaattacttgggaagtagagatcattttgctttagatagaccatcagaaacacatgctgattatttattaagaactggacaagttgttgatatttcagatactatttatcctagaaatccagctatgtattcagaagaagctagacttaagtcatttcaaaattggccagattatgcacatttaactccaagagaacttgcaagtgctggattgtattatactggaattggagatcaagttcaatgtttttgttgtggaggaaaattaaaaaattgggaaccatgtgatcgagcatggtcagaacatagaagacatttcccaaattgttttttcgtacttggaagaaatttaaatattagatctgaatcagatgcagtatcaagtgatcgtaatttcccaaacagtaccaatttacctagaaatccttcaatggctgactatgaggctagaatttttacatttggaacttggatatattctgttaataaagaacaacttgcaagggctggattttatgcattgggtgagggtgataaagttaagtgttttcattgtggtggagggttaactgactggaaaccaagtgaagatccatgggaacaacatgcaaaatggtatccaggatgcaaatatttattagagcaaaagggtcaagaatatattaataatattcatttaacacattcacttgaagaatgtttagttcgaactactgagaagacaccatcactaactagaagaattgatgatacgatttttcaaaatccaatggttcaagaagccattagaatgggatttagttttaaggatataaaaaagattatggaagaaaaaattcaaatttcaggatcaaattataaatcacttgaagttctagtagctgatttagtaaatgctcagaaagactcgatgcaagatgaatcaagtcaaactagtcttcaaaaagaaatttcaactgaagaacagctaaggagattacaagaagagaaactttgtaaaatttgtatggatagaaatatagcaatagtctttgttccatgtggacatttagttacttgtaaacaatgtgcagaagctgttgataaatgtcctatgtgttatacagttattacattcaagcaaaaaatttttatgtca

SEQ ID NO: 33877 - DNA, 1491 bp, Artificial Sequence
  Description of Artificial Sequence: Synthetic coding sequence
atgacgttcaatagttttgaaggctccaaaacctgcgttccggcagatatcaacaaggaggaagagttcgtggaggagtttaatcgactcaaaactttcgcaaattttccctccgggagcccagtgtctgccagtaccctcgcccgagcaggattcctgtataccggagagggtgacaccgtgcgatgtttctcatgccatgcggcggtagacaggtggcagtatggtgacagcgctgtgggaaggcataggaaagtcagtcctaactgtaggtttattaatgggttttatttagagaactcagccacccaatctacaaatagcggaattcaaaatggacagtacaaagttgagaactaccttggcagtcgagaccactttgcacttgatcgccccagtgagactcacgcagattacctgctgagaactgggcaagtcgtggacatcagtgacaccatctaccctcgtaaccccgctatgtattccgaagaggctcgtttgaaatctttccagaactggcctgattacgcccatttaacaccgagagagcttgctagcgctggtctctactacacaggcattggagatcaggtacagtgtttctgctgtggtggcaaactgaagaactgggagccatgcgaccgagcctggagcgagcatcgtcgccacttccctaactgttttttcgtccttggtcgcaacctgaatatccggagcgaatcagacgccgtcagttcagacaggaatttccccaattccactaacttgcctagaaatccctcgatggcggattatgaagcaaggatctttaccttcggcacgtggatttattctgtcaataaagagcagctggccagagctgggttttacgccctgggcgagggagataaggtgaagtgctttcactgcgggggagggttaactgattggaaaccttcagaggatccatgggaacagcacgccaagtggtaccccggatgtaagtatttgctggaacaaaaggggcaagaatacattaataatatccacttgacccattcactcgaagagtgcctggttcgaacaaccgagaaaacacccagcttgactcggcgaatcgacgacaccatttttcagaaccctatggtgcaggaggccatacgaatgggctttagctttaaggacataaagaagattatggaggagaaaatccagatctcaggaagcaactacaagtcactggaggtattagtggccgacctcgttaacgcccagaaagattcaatgcaagacgaaagctcccagaccagtctgcagaaggaaatctctacggaggagcaactgcgaagactgcaggaagaaaagctctgtaagatatgtatggacaggaatatagctatagtattcgtaccatgcggtcacttagtgacttgcaagcagtgtgccgaagccgtcgacaaatgccccatgtgttacactgtgatcacttttaagcaaaaaatctttatgtcg

SEQ ID NO: 33878 - DNA, 1491 bp, Artificial Sequence
  Description of Artificial Sequence: Synthetic coding sequence
atgactttcaactcctttgaagggtctaagacctgtgtgcctgccgacataaacaaggaagaagagtttgtggaagagttcaaccggcttaagacgtttgcgaattttccgtccggctcccctgtatccgcatccaccttggcgcgagccggatttctctacaccggggaaggcgacaccgtgaggtgcttctcctgccatgctgcagtcgaccggtggcagtacggggatagcgcggtggggcggcacagaaaggtgagcccaaattgtagattcatcaacggcttctacctcgagaattcggctactcagtccacgaactcgggcattcagaacgggcaatacaaggtcgagaactatctcgggtcgcgagatcatttcgcgctcgaccgcccgtctgagactcacgctgattacctgcttcggactggccaggtggttgacatctcagacaccatttacccacggaatccggccatgtactcggaggaagccagactcaaatccttccaaaactggccagactacgctcacctgacgccgcgggaactggcctcggccgggctgtactataccggaatcggagatcaggtccaatgcttctgctgtggcgggaaactgaagaactgggaaccatgcgaccgcgcctggagcgaacataggaggcatttccccaactgcttcttcgtccttggacgcaatttgaatatcagatcggagtcagacgctgtgtcgtcggacaggaacttcccaaacagcaccaacctgccccgcaaccccagcatggccgactacgaagcgcgcattttcactttcggaacttggatctactccgtgaataaggaacagttggccagagcaggcttctacgctctcggcgagggggataaggtcaagtgctttcactgcggaggaggactgaccgattggaagccatccgaagatccgtgggaacaacacgccaagtggtacccaggttgtaagtatctgttggagcagaaaggtcaggaatacatcaacaacatccatctgacgcactcgctcgaggaatgtctggtccgcaccactgagaaaactcccagcctgactcggcggatcgatgacactattttccagaatccgatggtgcaggaggccattagaatgggatttagcttcaaagacatcaagaagataatggaggaaaagatccagatctccggttccaactacaaatcactcgaagtgctcgtggccgacttggttaatgcccaaaaggattccatgcaagacgagtcaagccagacctctctccagaaagagatctccaccgaggaacaacttcgccggctgcaggaagagaagctgtgcaagatctgtatggatcgtaatatcgctatcgtctttgtgccgtgcgggcacctggtgacttgtaagcaatgtgcagaagcagtggacaaatgccctatgtgctacaccgtgatcactttcaaacagaagatattcatgagc

SEQ ID NO: 33879 - DNA, 1491 bp, Artificial Sequence
  Description of Artificial Sequence: Synthetic coding sequence
atgacgtttaattcgtttgaaggttcgaaaacgtgtgttccggcggatataaataaagaagaagaatttgttgaagaatttaatcgtttaaaaacgtttgcgaattttccgtcgggttcgccggtatcggcgtcgacgttagcgcgtgcgggttttttatatacgggtgaaggtgatacggttcgttgtttttcgtgtcatgcggcggtagatcgatggcaatatggtgattcggcggttggtcgacatcgtaaagtatcgccgaattgtcgatttataaatggtttttatttagaaaattcggcgacgcaatcgacgaattcgggtatacaaaatggtcaatataaagtagaaaattatctaggttcgcgtgatcattttgcgttagatcgtccgtcggaaacgcatgcggattatttattacgaacgggtcaagttgtagatatatcggatacgatatatccgcgaaatccggcgatgtattcggaagaagcgcgattaaaatcgtttcaaaattggccggattatgcgcatctaacgccgcgtgaactagcgtcggcgggtttatattatacgggtataggtgatcaagtacaatgtttttgttgtggtggtaaactaaaaaattgggaaccgtgtgatcgagcgtggtcggaacatcgtcgtcattttccgaattgtttttttgttttaggtcgtaatttaaatatacgttcggaatcggatgcggtttcgtcggatcgaaattttccgaattcgacgaatttaccgcgaaatccgtcgatggcggattatgaagcgcgaatatttacgtttggtacgtggatatattcggtaaataaagaacaattagcgcgtgcgggtttttatgcgttaggtgaaggtgataaagtaaaatgttttcattgtggtggtggtttaacggattggaaaccgtcggaagatccgtgggaacaacatgcgaaatggtatccgggttgtaaatatctattagaacaaaaaggtcaagaatatataaataatatacatttaacgcattcgttagaagaatgtctagttcgtacgacggaaaaaacgccgtcgctaacgcgtcgaatagatgatacgatatttcaaaatccgatggttcaagaagcgatacgtatgggtttttcgtttaaagatataaaaaaaataatggaagaaaaaatacaaatatcgggttcgaattataaatcgctagaagtattagttgcggatctagttaatgcgcaaaaagattcgatgcaagatgaatcgtcgcaaacgtcgctacaaaaagaaatatcgacggaagaacaactacgtcgtttacaagaagaaaaattatgtaaaatatgtatggatcgaaatatagcgatagtatttgtaccgtgtggtcatttagtaacgtgtaaacaatgtgcggaagcggtagataaatgtccgatgtgttatacggtaataacgtttaaacaaaaaatatttatgtcg

SEQ ID NO: 33880 - DNA, 1491 bp, Artificial Sequence
  Description of Artificial Sequence: Synthetic coding sequence
atgaccttcaactcctttgagggttcaaagacctgcgtgcctgcggacatcaacaaagaagaggaattcgtggaggagttcaataggctgaaaaccttcgccaactttccgtctggatcaccggtgtcggctagcactctggcgcgggcaggattcctgtacaccggagagggggatactgtgcggtgcttctcgtgccacgcggcagtggatcgatggcaatacggagatagcgctgtcggccgccatcggaaggtgtcacccaactgcagattcatcaacggattctacctggaaaacagcgccacccaatccacgaattcggggatccaaaacggacagtacaaggtcgaaaactacctcgggtcccgggatcattttgcgctggatagaccgtcggaaacccatgccgactacctgctgaggactggacaggtcgtcgacatctcggacactatttacccgcgcaatccggccatgtactcagaggaagcccgcctcaagagctttcagaattggccagattacgcccacctcactccacgggagctcgcctcggccggactctactacaccggaattggcgaccaggtccagtgtttctgttgcggtggaaagctcaagaattgggaaccttgcgaccgcgcctggagcgaacaccggcgccatttcccgaactgtttcttcgtgctcggccggaacctgaacatccgcagcgaatcggatgccgtatcttcagaccgcaattttccgaactccactaacctgccgcgcaacccatcgatggccgattacgaagctaggatcttcaccttcgggacgtggatatactccgttaacaaagagcagctcgcaagggccggtttttacgcacttggagagggagacaaggtgaagtgtttccactgcggaggaggactgaccgactggaagccttcagaggacccgtgggagcagcacgctaagtggtacccgggatgcaagtacctccttgaacaaaagggacaagaatacatcaataacatacatctcactcactctctggaggaatgtttggtgcggactactgaaaagactccgtcgttgactcgcaggattgacgatactatctttcaaaacccgatggtgcaggaggctatccgcatgggattctccttcaaagatatcaaaaagatcatggaggagaagatccaaatcagcgggagcaattacaaatctctggaggtgctggtggccgacctggtgaacgcgcagaaagattcgatgcaggacgaatccagccagacttccttgcagaaagagatctccactgaagaacaactccggcgcctccaggaagaaaagctgtgtaagatctgcatggatcgcaacatcgctatcgtgtttgtgccttgcggacacctggtcacttgcaagcagtgcgcggaagctgtggacaagtgccccatgtgctacactgtcatcactttcaagcagaagatcttcatgtcg

SEQ ID NO: 33881 - DNA, 1491 bp, Artificial Sequence
  Description of Artificial Sequence: Synthetic coding sequence
atgacattcaactcgttcgagggaagtaagacctgtgtacccgccgacattaataaggaggaggaatttgtggaggagttcaacagattaaaaacctttgcaaacttccctagcggtagccctgtgtccgccagcaccctcgcgagggcaggtttcctctacactggtgagggggacacggtgcggtgcttttcttgtcacgcagccgtggatagatggcagtatggcgactcagccgttggccgacacagaaaagttagtcctaactgccggttcatcaacggcttctacctggagaatagtgccacccagtccacaaactccgggatccagaatggacaatacaaagtcgaaaactaccttggctcccgggaccacttcgccctggatagaccatccgagacccatgctgactatctcctgagaactggtcaagtcgttgacatctcggacacaatatatccccggaatcctgccatgtatagcgaagaggctcgactgaagagctttcagaactggcccgactacgcacacctcacgcctcgggaattagcctcagcgggactgtactatactggaatcggagatcaggttcagtgtttttgttgtggcggtaaattaaagaattgggagccatgtgatcgggcctggtcagagcaccgccgacattttcccaactgcttcttcgtcctgggacggaatctcaacattaggagcgagtcagacgccgtgagtagcgatcggaactttccgaatagcaccaatctgccccgcaacccttctatggccgactacgaggcccgaatctttacattcgggacctggatttacagcgtaaacaaagagcaattggcgagggccggattttacgcgctgggtgagggtgataaggtaaaatgcttccattgtggaggcgggcttactgattggaagcctagcgaggatccctgggagcagcacgcaaagtggtatccgggttgtaagtatctgctcgaacagaagggccaggagtacataaacaacatccatctcactcatagtctggaagagtgccttgtcagaacgaccgagaagaccccttcattgacccgtaggatcgatgacactatctttcagaatccaatggtgcaggaggccattcgaatggggttctccttcaaggatatcaagaagatcatggaagaaaaaatacagatatcgggaagcaattacaagtcattggaggtgctagtcgccgatcttgtgaacgcccagaaagactccatgcaggatgagtctagtcagacatccctacagaaagagatcagtactgaagagcagcttagaaggctgcaggaagaaaagctgtgtaaaatctgcatggacagaaacatcgctatagtattcgtcccttgtgggcacttggtcacatgcaagcagtgcgctgaagccgtggacaagtgccctatgtgctatacagtaataaccttcaagcagaaaatttttatgtcc

SEQ ID NO: 33882 - DNA, 1491 bp, Artificial Sequence
  Description of Artificial Sequence: Synthetic coding sequence
atgacctttaactcgttcgaagggtcaaagacctgcgtccccgccgatatcaacaaggaagaagagttcgtggaagagtttaaccggttgaaaactttcgcgaactttccgtccgggtcgccagtctccgcctccactctggcccgggccggcttcctctacaccggggaaggagatacggtgagatgcttctcatgccatgcagccgtggacagatggcaatatggagactcagcggtgggccggcacagaaaggtgtcacctaactgccgctttatcaacgggttttaccttgaaaactcggcgactcagtccactaattcgggaatccaaaatggccagtataaggtggagaattacctcggatcccgggaccatttcgcgctggacagaccgtccgagactcacgcagactatctgctccggactggacaggtggttgacatcagcgacactatctacccgcgcaatccagccatgtactcagaagaagctaggctcaagtcatttcaaaactggcctgattacgctcacctgactcccagggagctggcctcagccggcctgtactacaccggcattggcgatcaggtgcaatgcttttgttgcggaggaaagctcaagaactgggaaccatgcgacagagcctggtcagaacatagacgccatttcccgaattgcttcttcgtcctgggacgcaatttgaacatcagatccgagtccgatgctgtgagctcggaccggaacttccctaatagcacgaatctgcccagaaacccatcgatggcggattacgaagcgaggatcttcactttcgggacttggatctactcggtgaacaaggaacagctcgcccgggcagggttctacgcattgggcgaaggtgacaaggtgaaatgcttccactgcggcggaggccttactgactggaaaccgtccgaggacccttgggagcaacatgccaagtggtacccaggatgtaagtatttgctggagcagaagggacaggaatacatcaacaatatccatctgacccactctctggaggaatgcctggtgcgaacgaccgaaaagaccccgtcgctgacccgccggatcgatgataccatctttcaaaatccgatggtccaggaagcgattcgcatgggcttctcgttcaaggacatcaagaagataatggaggagaagatccaaatctcaggctccaattacaaatcgctggaagtgctcgtggctgatcttgtgaatgcccaaaaggactcaatgcaagacgagagctcgcaaacttcactgcaaaaggagatctcgaccgaagagcagctgagacgcctgcaagaggagaagctctgcaaaatctgcatggaccgcaatatcgctatcgtgtttgtgccttgcggacacctggtgacctgcaaacagtgcgctgaagccgtcgacaagtgcccgatgtgctacaccgtcatcactttcaagcaaaagatcttcatgtcg

SEQ ID NO: 33883 - protein, 4 aa, Homo sapiens
  MOD_RES (2)..(3): Any amino acid
RXXR

SEQ ID NO: 33884 - protein, 4 aa, Homo sapiens
  MOD_RES (2)..(2): Any amino acid
  MOD_RES (3)..(3): Lys or Arg
RXXR

SEQ ID NO: 33885 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 33886 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 33887 - protein, 6 aa, Homo sapiens
LVPRGS

SEQ ID NO: 33888 - protein, 4 aa, Homo sapiens
LVPR

SEQ ID NO: 33889 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 33890 - protein, 4 aa, Homo sapiens
IEGR

SEQ ID NO: 33891 - protein, 4 aa, Homo sapiens
IDGR

SEQ ID NO: 33892 - protein, 4 aa, Homo sapiens
AEGR

SEQ ID NO: 33893 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 33894 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 33895 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 33896 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 33897 - RNA, 758 nt, Artificial Sequence
  Description of Artificial Sequence: Synthetic transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 33898 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 33899 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 33900 - RNA, 725 nt, Artificial Sequence
  Description of Artificial Sequence: Synthetic transcript sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 33901 - RNA, 1536 nt, Artificial Sequence
  Description of Artificial Sequence: Synthetic transcript sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 33902 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 33903 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 33904 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 33905 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 33906 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 33907 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 33908 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 33909 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 33910 - RNA, 716 nt, Artificial Sequence
  Description of Artificial Sequence: Synthetic transcript sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 33911 - RNA, 1316 nt, Artificial Sequence
  Description of Artificial Sequence: Synthetic transcript sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 33912 - RNA, 806 nt, Artificial Sequence
  Description of Artificial Sequence: Synthetic transcript sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 33913 - RNA, 1573 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 33914 - RNA, 1568 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 33915 - RNA, 863 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag
